(12) United States Patent
Schomburg et al.

(10) Patent No.: US 12,409,219 B2
(45) Date of Patent: Sep. 9, 2025

(54) RECOMBINANT POLYPEPTIDES CONTAINING AT LEAST ONE IMMUNOGENIC FRAGMENT AND USES THEREOF

(71) Applicant: Boost Biopharma, Inc., Woburn, MA (US)

(72) Inventors: Fritz M. Schomburg, Madison, WI (US); David M. Rancour, Madison, WI (US)

(73) Assignee: Boost Biopharma, Inc., Woburn, MA (US)

( * ) Notice: Subject to any disclaimer, the term of this patent is extended or adjusted under 35 U.S.C. 154(b) by 721 days.

(21) Appl. No.: 17/728,798

(22) Filed: Apr. 25, 2022

(65) Prior Publication Data

US 2022/0288194 A1 Sep. 15, 2022

Related U.S. Application Data

(63) Continuation-in-part of application No. 17/535,309, filed on Nov. 24, 2021, now Pat. No. 11,358,990, which is a continuation of application No. PCT/US2021/040019, filed on Jun. 30, 2021.

(60) Provisional application No. 63/154,647, filed on Feb. 26, 2021, provisional application No. 63/046,426, filed on Jun. 30, 2020.

(51) Int. Cl.
| | |
|---|---|
| *C07K 14/005* | (2006.01) |
| *A61K 39/00* | (2006.01) |
| *A61K 39/215* | (2006.01) |
| *A61K 47/02* | (2006.01) |
| *A61P 31/14* | (2006.01) |
| *C07K 14/165* | (2006.01) |
| *C07K 16/10* | (2006.01) |

(52) U.S. Cl.
CPC ............ *A61K 39/215* (2013.01); *A61K 47/02* (2013.01); *A61P 31/14* (2018.01); *C07K 14/165* (2013.01); *A61K 2039/55511* (2013.01)

(58) Field of Classification Search
CPC ......................... C07K 14/005; C07K 2319/30; C07K 14/165; C07K 2319/00; C12N 2770/20022
See application file for complete search history.

(56) References Cited

FOREIGN PATENT DOCUMENTS

| CN | 111333704 A | 6/2020 |
|---|---|---|
| CN | 112321688 A | 2/2021 |
| CN | 113173977 A | 7/2021 |
| CN | 113186173 A | 7/2021 |
| CN | 113321739 A | 8/2021 |
| IN | 202347005085 A | 2/2023 |
| RU | 2720614 C1 | 5/2020 |
| RU | 2 761 897 C1 | 12/2021 |
| WO | WO 2021/163536 A2 | 8/2021 |
| WO | WO 2021/163536 A3 | 8/2021 |
| WO | WO 2021/174198 A1 | 9/2021 |
| WO | WO 2021/195089 A1 | 9/2021 |
| WO | WO 2021/207306 A1 | 10/2021 |
| WO | WO 2021/207599 A1 | 10/2021 |
| WO | WO 2021/207599 A9 | 10/2021 |
| WO | WO 2021/228167 A1 | 11/2021 |
| WO | WO 2021/251453 A1 | 12/2021 |
| WO | WO 2022/006357 A2 | 1/2022 |
| WO | WO 2022/006357 A3 | 1/2022 |
| WO | WO 2023/130089 A1 | 7/2023 |
| WO | WO 2023/130096 A2 | 7/2023 |
| WO | WO 2023/130096 A3 | 7/2023 |
| WO | WO 2023/212579 A1 | 11/2023 |

OTHER PUBLICATIONS

United States Patent Office, International Search Report and Written Opinion issued in International Application No. PCT/US2021/040019, 12 pp. (Jan. 5, 2022).
Ahmed et al., "Preliminary identification of potential vaccine targets for the COVID-19 coronavirus (SARS-CoV-2) based on SARS-CoV immunological studies." *Viruses*, 12(254): 1-15 (2020).
Bar-On et al., "Science Forum: SARS-CoV-2 (COVID-19) by the numbers." *Elife*, 9: 1-15 (2020).
Bastard et al., "Autoantibodies neutralizing type I IFNs are present in~4% of uninfected individuals over 70 years old and account for~20% of COVID-19 deaths." *Science immunology*, 6(62): 1-40 (2021).
Bracken et al., "Bi-paratopic and multivalent VH domains block ACE2 binding and neutralize SARS-CoV-2." *Nature chemical biology*, 17(1): 113-121 (2021).
Breedveld et al., "IgA and FcaRI: pathological roles and therapeutic opportunities." *Frontiers in immunology*, 10(553): 1-20 (2019).
Caforio, Alida, "Receipt of mRNA Vaccine against Covid-19 and Myocarditis." *New England Journal of Medicine*, 385(23): 2189-2190 (2021).
Callaway, Ewen, "Beyond Omicron: what's next for COVID's viral evolution." *Nature*, 600: 204-207 (2021).
Carreño et al., "Activity of convalescent and vaccine serum against SARS-CoV-2 Omicron." *Nature*, 1-8 (2021).
Carter et al., "Assay techniques and test development for COVID-19 diagnosis." *American Chemical Society*, 6: 591-605 (2020).
Cele et al., "Escape of SARS-CoV-2 501Y. V2 from neutralization by convalescent plasma." *MedRxiv*, 1-25 (2021).
Chakrabarti et al., "Studies to prevent degradation of recombinant Fc-fusion protein expressed in mammalian cell line and protein characterization." *International journal of molecular sciences*, 17(6): 1-22 (2016).
Chan et al., "Genomic characterization of the 2019 novel human-pathogenic coronavirus isolated from a patient with atypical pneumonia after visiting Wuhan." *Emerging microbes & infections*, 9(1): 221-236 (2020).
Chertow et al., "SARS-CoV-2 infection and persistence throughout the human body and brain." *Research Square*, 1-56 (2021).

(Continued)

*Primary Examiner* — Barry A Chestnut
(74) *Attorney, Agent, or Firm* — Leydig, Voit & Mayer, Ltd.

(57) ABSTRACT

Provided is a recombinant polypeptide containing at least one immunogenic fragment of Severe Acute Respiratory Syndrome Coronavirus 2 (SARS-CoV-2) spike glycoprotein, and pharmaceutical compositions containing the same.

20 Claims, 9 Drawing Sheets

Specification includes a Sequence Listing.

(56) References Cited

OTHER PUBLICATIONS

Chi et al., "A neutralizing human antibody binds to the N-terminal domain of the Spike protein of SARS-CoV-2." *Science*, 369(6504): 650-655 (2020).
Crooke et al., "Immunoinformatic identification of B cell and T cell epitopes in the SARS-CoV-2 proteome." *Scientific reports*, 10(1): 1-15 (2020).
Cui et al., "Origin and evolution of pathogenic coronaviruses." *Nature Reviews Microbiology*, 17(3): 181-192 (2019).
Dai et al., "A universal design of betacoronavirus vaccines against COVID-19, MERS, and SARS." *Cell*, 182(3): 722-733 (2020).
Damas et al., "Broad host range of SARS-CoV-2 predicted by comparative and structural analysis of ACE2 in vertebrates," *PNAS*, 117(36): 22311-22322 (2020).
Davanzo et al., "SARS-CoV-2 uses CD4 to infect T helper lymphocytes." *MedRxiv*, 1-18 (2020).
Defrancesco, Laura, "Preparing for the next plague." *Nature biotechnology*, 39(12): 1491-1496 (2021).
Dejnirattisai et al., "SARS-CoV-2 Omicron-B. 1.1. 529 leads to widespread escape from neutralizing antibody responses." *Cell*, 185: 467-484 (2022).
Diamos et al., "A highly expressing, soluble, and stable plant-made IgG fusion vaccine strategy enhances antigen immunogenicity in mice without adjuvant." *Frontiers in immunology*, 11(576012): 1-14 (2020).
Duivelshof et al., "Therapeutic Fc-fusion proteins: Current analytical strategies." *Journal of Separation Science*, 44(1): 35-62 (2021).
Eguia et al., "A human coronavirus evolves antigenically to escape antibody immunity." *PLoS pathogens*, 17(4): 1-28 (2021).
El-Elimat et al., "Acceptance and attitudes toward COVID-19 vaccines: a cross-sectional study from Jordan." *Plos One*, 16(4): 1-15 (2021).
Faria et al., "Genomic characterisation of an emergent SARS-CoV-2 lineage in Manaus: preliminary findings." *Virological*, 372: 815-821 (2021).
Gaebler et al., "Evolution of antibody immunity to SARS-Cov-2." *Nature*, 591(7851): 639-644 (2021).
Gagne et al., "mRNA-1273 or mRNA-Omicron boost in vaccinated macaques elicits expansion, neutralizing antibodies and protection against Omicron." *bioRxiv*, 1-51 (2022).
Garcia-Beltran et al., "mRNA-based COVID-19 vaccine boosters induce neutralizing immunity against SARS-CoV-2 Omicron variant." *Cell* 185: 457-466 (2022).
Georg et al., "Complement activation induces excessive T cell cytotoxicity in severe COVID-19." *Cell* 185(3): 493-512 (2022).
Geurtsvankessel et al., "An evaluation of COVID-19 serological assays informs future diagnostics and exposure assessment." *Nature communications*, 11(1): 1-5 (2020).
Golden et al., "Hamsters Expressing Human Angiotensin-Converting Enzyme 2 Develop Severe Disease following Exposure to SARS-CoV-2." *mBio*, 13(1): 1-16 (2022).
Graham et al., "Evaluation of the immunogenicity of prime-boost vaccination with the replication-deficient viral vectored COVID-19 vaccine candidate ChAdOx1 nCoV-19," *bioRxiv*: 1-11 (2020).
Grifoni et al., "Targets of T cell responses to SARS-CoV-2 coronavirus in humans with COVID-19 disease and unexposed individuals." *Cell*, 181(7): 1489-1501 (2020).
Hachim et al., "Beyond the Spike: identification of viral targets of the antibody responses to SARS-CoV-2 in COVID-19 patients." *MedRxiv*, 1-33 (2020).
Harris et al., "A place for viruses on the tree of life." *Frontiers in Microbiology*, 11(604048): 1-16 (2021).
Harvey et al., "SARS-CoV-2 variants, spike mutations and immune escape." *Nature Reviews Microbiology*, 19(7): 409-424 (2021).
Hasenkrug et al., "Recovery from acute SARS-CoV-2 infection and development of anamnestic immune responses in T cell-depleted rhesus macaques." *Mbio*, 12(4): 1-16 (2021).

Hendy et al., "Molecular strategies for antibody binding and escape of SARS-CoV-2 and its mutations." *Scientific reports*, 11(1): 1-11 (2021).
Hoffmann et al., "SARS-CoV-2 cell entry depends on ACE2 and TMPRSS2 and is blocked by a clinically proven protease inhibitor." *Cell*, 181(2): 271-280 (2020).
Hoffmann et al., "The Omicron variant is highly resistant against antibody-mediated neutralization: Implications for control of the COVID-19 pandemic." *Cell* 185(3): 447-456 (2022).
Hosaka et al., "Arg-X-Lys/Arg-Arg motif as a signal for precursor cleavage catalyzed by furin within the constitutive secretory pathway." *Journal of Biological Chemistry*, 266(19): 12127-12130 (1991).
Imai et al., "Report 3: transmissibility of 2019-nCOV." *Imperial College London*, 1(25) (2020).
Jackson et al., "An mRNA vaccine against SARS-CoV-2— preliminary report." *New England Journal of Medicine*, 1-12 (2020).
Killingley et al., "Safety, tolerability and viral kinetics during SARS-CoV-2 human challenge." *Nature Portfolio*, 1-27 (2022).
Kuo et al., "Development of CpG-adjuvanted stable prefusion SARS-CoV-2 spike antigen as a subunit vaccine against COVID-19." *Scientific reports*, 10(1): 1-10 (2020).
Lan et al., "Structure of the SARS-CoV-2 spike receptor-binding domain bound to the ACE2 receptor." *Nature*, 581(7807): 215-220 (2020).
Lempp et al., "Lectins enhance SARS-CoV-2 infection and influence neutralizing antibodies." *Nature*, 598(7880): 342-347 (2021).
Li et al., "High potency of a bivalent human VH domain in SARS-CoV-2 animal models." *Cell*, 183(2): 429-441 (2020).
Li, Fang, "Receptor recognition mechanisms of coronaviruses: a decade of structural studies." *Journal of virology*, 89(4): 1954-1964 (2015).
Li, Fang, "Structure, function, and evolution of coronavirus spike proteins." *Annual review of virology*, 3(27): 237-261 (2016).
Lu et al., "Neutralization of SARS-CoV-2 Omicron variant by sera from BNT162b2 or Coronavac vaccine recipients." *medRxiv*, 1-21 (2021).
Mandavilli, Apoorva, "The Covid Vaccine We Need Now May Not Be a Shot." *The New York Times*, 1-4 (2022).
McKelvey et al., "Proteases, Mucus, and Mucosal Immunity in Chronic Lung Disease." *International Journal of Molecular Sciences*, 22(9): 1-21 (2021).
Miller et al., "FN3-based monobodies selective for the receptor binding domain of the SARS-CoV-2 spike protein." *New biotechnology*, 62: 79-85 (2021).
Morel et al., "Adjuvant System AS03 containing α-tocopherol modulates innate immune response and leads to improved adaptive immunity." *Vaccine*, 29(13); 2461-2473 (2011).
Muruato et al., "A high-throughput neutralizing antibody assay for COVID-19 diagnosis and vaccine evaluation." *BioRxiv*, 1-14 (2020).
Nabeel-Shah et al., "SARS-CoV-2 Nucleocapsid protein attenuates stress granule formation and alters gene expression via direct interaction with host mRNAs." *BioRxiv*, 1-29 (2020).
Nanishi et al., "An aluminum hydroxide: CpG adjuvant enhances protection elicited by a SARS-CoV-2 receptor-binding domain vaccine in aged mice." *Science translational medicine*, 14: 1-18 (2022).
Pach et al., "ACE2-Variants Indicate Potential SARS-CoV-2-Susceptibility in Animals: A Molecular Dynamics Study." *Molecular informatics*, 40(9): 1-13 (2021).
Pasquale et al., "Vaccine adjuvants: from 1920 to 2015 and beyond." *Vaccines*, 3(2): 320-343 (2015).
Pechtner et al., "A new approach to drug therapy: Fo-fusion technology." *Prim Health Care*, 7(1): 1-5 (2017).
Phillips, Nicky, "The coronavirus is here to stay—here's what that means." *Nature*, 590(7846): 382-384 (2021).
Philippens et al., "SARS-CoV-2 causes brain inflammation and induces Lewy body formation in macaques." *BioRxiv*, 1-28 (2021).
Rahnavard et al., "Epidemiological associations with genomic variation in SARS-CoV-2." *Scientific reports*, 11(1): 1-10 (2021).
Ramvikas et al., "Nasal vaccine delivery." *Micro and Nanotechnology in Vaccine Development*, 279-301 (2017).

(56) References Cited

OTHER PUBLICATIONS

Reed et al., "Key roles of adjuvants in modern vaccines." *Nature medicine*, 19(12): 1597-1608 (2013).
Ren et al., "Difference in receptor usage between severe acute respiratory syndrome (SARS) coronavirus and SARS-like coronavirus of bat origin." *Journal of virology*, 82(4): 1899-1907 (2008).
Ren et al., "Recombinant SARS-CoV-2 spike S1-Fc fusion protein induced high levels of neutralizing responses in nonhuman primates," *Vaccine*, 38(35): 5653-5658 (2020).
Saadat et al., "Binding and neutralization antibody titers after a single vaccine dose in health care workers previously infected with SARS-CoV-2." *Jama*, 325(14): 1467-1469 (2021).
Sasaki et al., "Nasal alum-adjuvanted vaccine promotes IL-33 release from alveolar epithelial cells that elicits IgA production via type 2 immune responses." *PLoS Pathogens*, 17(8): 1-25 (2021).
Schreiber et al., "Risk of SARS-CoV-2 transmission from on-field player contacts in amateur, youth and professional football (soccer)." *British journal of sports medicine*, 56(3): 158-164 (2021).
Siddle et al., "Transmission from vaccinated individuals in a large SARS-CoV-2 Delta variant outbreak." *Cell*,185(3): 485-492 (2022).
Starr et al., "Deep mutational scanning of SARS-CoV-2 receptor binding domain reveals constraints on folding and ACE2 binding." *Cell*, 182(5): 1295-1310 (2020).
Sun et al., "Interferon-armed RBD dimer enhances the immunogenicity of RBD for sterilizing immunity against SARS-CoV-2." *Cell Research*, 31(9): 1011-1023 (2021).
Sun et al., "Recombinant vaccine containing an RBD-Fc fusion induced protection against SARS-CoV-2 in nonhuman primates and mice." *Cellular & molecular immunology*, 18(4): 1070-1073 (2021).
Svilenov et al., "Picomolar inhibition of SARS-CoV-2 variants of concern by an engineered ACE2-IgG4-Fc fusion protein." *Antiviral research*, 196: 1-26 (2021).
Syed et al., "Rapid assessment of SARS-CoV-2-evolved variants using virus-like particles." *Science*, 374(6575): 1626-1632 (2021).
Taylor et al., "Fc receptors in antibody-dependent enhancement of viral infections." *Immunological reviews*, 268(1): 340-364 (2015).
Tzaban et al., "The recycling and transcytotic pathways for IgG transport by FcRn are distinct and display an inherent polarity." *Journal of Cell Biology*, 185(4): 673-684 (2009).
Ulrich et al., "CD147 as a target for COVID-19 treatment: suggested effects of azithromycin and stem cell engagement." *Stem cell reviews and reports*, 16(3): 434-440 (2020).
Van Doremalen et al., "Intranasal ChAdOx1 nCoV-19/AZD1222 vaccination reduces viral shedding after SARS-CoV-2 D614G challenge in preclinical models." *Science translational medicine*, 13(607): 1-15 (2021).
Walls et al., "Structure, function, and antigenicity of the SARS-CoV-2 spike glycoprotein." *Cell*, 180: 1-12 (2020).
Walls et al., "Tectonic conformational changes of a coronavirus spike glycoprotein promote membrane fusion." *Proceedings of the National Academy of Sciences*, 114(42): 11157-11162 (2017).
Wang et al., "Importance of neutralizing monoclonal antibodies targeting multiple antigenic sites on the Middle East respiratory syndrome coronavirus spike glycoprotein to avoid neutralization escape." *Journal of virology*, 92(10): e02002-e02017 (2018).
Wang et al., "Mechanisms of SARS-CoV-2 evolution revealing vaccine-resistant mutations in Europe and America." *The Journal Of Physical Chemistry Letters*, 12(49): 11850-11857 (2021).
Wang et al., "mRNA vaccine-elicited antibodies to SARS-CoV-2 and circulating variants." *BioRxiv*, 1-52 (2021).
Wang et al., "SARS-CoV-2 invades host cells via a novel route: CD147-spike protein." *BioRxiv*, 1-10 (2020).
Wang et al., "Structural and functional basis of SARS-CoV-2 entry by using human ACE2." *Cell*, 181(4): 894-904 (2020).
Warner et al., "Angiotensin-converting enzyme-2: a molecular and cellular perspective." *Cellular and molecular life sciences, CMLS* 61(21): 2704-2713 (2004).
Warner et al., "Angiotensin-converting enzyme 2 (ACE2), but not ACE, is preferentially localized to the apical surface of polarized kidney cells." *Journal of Biological Chemistry*, 280(47): 39353-39362 (2005).
Weisblum et al., "Escape from neutralizing antibodies by SARS-CoV-2 spike protein variants." *Elife*, 9: 1-31 (2020).
Wilkins et al., "AS03-and MF59-adjuvanted influenza vaccines in children." *Frontiers in immunology*, 8(1760): 1-17 (2017).
Willcox et al., "Macaque-human differences in SARS-CoV-2 Spike antibody response elicited by vaccination or infection." *bioRxiv*, 1-48 (2021).
Wong et al., "A 193-amino acid fragment of the SARS coronavirus S protein efficiently binds angiotensin-converting enzyme 2." *Journal of Biological Chemistry*, 279(5): 3197-3201 (2004).
Xia et al., "Fusion mechanism of 2019-nCoV and fusion inhibitors targeting HR1 domain in spike protein." *Cellular & molecular immunology*, 17(7): 765-767 (2020).
Yan et al., "Structural basis for the recognition of SARS-CoV-2 by full-length human ACE2." *Science*, 367(6485): 1444-1448 (2020).
Yang et al., "A vaccine targeting the RBD of the S protein of SARS-CoV-2 induces protective immunity." *Nature*, 586(7830): 572-577 (2020).
Yang et al., "Analysis of genomic distributions of SARS-CoV-2 reveals a dominant strain type with strong allelic associations." *Proceedings of the National Academy of Sciences*, 117(48): 30679-30686 (2020).
Yang et al., "Engineering of Fc fragments with optimized physicochemical properties implying improvement of clinical potentials for Fc-based therapeutics." *Frontiers in immunology*, 8(1860): 1-14 (2018).
Yang et al., "Molecular interaction and inhibition of SARS-CoV-2 binding to the ACE2 receptor." *Nature communications*,11(1): 1-10 (2020).
Ying et al., "Boosting with Omicron-matched or historical mRNA vaccines increases neutralizing antibody responses and protection against B. 1.1. 529 infection in mice." *bioRxiv*, 1-46 (2022).
Zahradník et al., "SARS-CoV-2 variant prediction and antiviral drug design are enabled by RBD in vitro evolution." *Nature microbiology*, 6(9): 1188-1198 (2021).
Zaidi et al., "The mechanisms of action of ivermectin against SARS-CoV-2—an extensive review." *The Journal of antibiotics*, 1-12 (2021).
Zhang et al., "Emergence of a novel SARS-CoV-2 strain in Southern California, USA." *MedRxiv*, 1-6 (2021).
Zhao et al., "Analysis of the epidemic growth of the early 2019-nCoV outbreak using internationally confirmed cases." *MedRxiv*, 1-10 (2020).
Zhao et al., "SARS-CoV-2 specific memory T cell epitopes identified in COVID-19-recovered subjects." *Virus Research*, 304: 1-14 (2021).
Jackson et al., "Mechanisms of SARS-CoV-2 entry into cells", Nature Reviews Molecular Cell Biology, vol. 23(1): pp. 3-20 (2021).
European Patent Office, Communication pursuant to Rule 164(1) EPC issued in European Patent Application No. 21833072.8, 16 pp. (Jun. 25, 2024).
Xia, Xuhua, "Domains and Functions of Spike Protein in SARS-Cov-2 in the Context of Vaccine Design", *Viruses*, vol. 13(109): pp. 1-16 (Jan. 14, 2021).
European Patent Office, International Search Report and Written Opinion issued in International Application No. PCT/US2022/082653, 19 pp. (Jun. 20, 2023).
European Patent Office, International Search Report and Written Opinion issued in International Application No. PCT/US2022/082665, 19 pp. (Jul. 31, 2023).
European Patent Office, International Search Report and Written Opinion issued in International Application No. PCT/US2023/066212, 15 pp. (Sep. 28, 2023).
European Patent Office, Extended European Search Report issued in European Application No. 21833072.8 (Nov. 7, 2024).

RECOMBINANT POLYPEPTIDES CONTAINING AT LEAST ONE IMMUNOGENIC FRAGMENT AND USES THEREOF

CROSS-REFERENCE TO PRIOR APPLICATION

This application claims benefit to pending U.S. patent application Ser. No. 17/535,309, filed Nov. 24, 2021, which is a continuation application of International Patent Application No. PCT/US2021/040019, filed Jun. 30, 2021, which claims benefit to U.S. Provisional Patent Applications No. 63/046,426, filed Jun. 30, 2020, and 63/154,647, filed Feb. 26, 2021, all of which are each hereby incorporated by reference in their entireties.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 848,455Byte ASCII (Text) file named "759990_ST25.txt," created on Apr. 15, 2022.

BACKGROUND OF THE INVENTION

The rapid evolution of new SARS-CoV-2 variants containing mutations that alter the amino acid sequence of the Spike protein resulting in altered function, and altered resistance to native immune defenses and to immune defenses elicited by currently marketed vaccines has led to a need for alternative platforms that allow for incorporation of new variant mutations in a robust vaccine.

BRIEF SUMMARY OF THE INVENTION

The present invention relates to recombinant polypeptides that include at least one immunogenic fragment of Severe Acute Respiratory Syndrome Coronavirus 2 (SARS-CoV-2) spike glycoprotein and, optionally, an antibody Fc region. In some embodiments, the recombinant polypeptide includes more than one immunogenic fragment, e.g., two, three, four, five, or more immunogenic fragments. In some embodiments, the recombinant polypeptide includes one or more immunogenic fragments of Severe Acute Respiratory Syndrome Coronavirus (SARS-CoV) and/or Middle Eastern Respiratory Syndrome Coronavirus (MERS-CoV) and optionally an antibody Fc region, optionally in combination with one or more SARS-CoV-2 immunogenic fragments.

The present invention further relates to pharmaceutical compositions, such as vaccines, that include the recombinant polypeptide. In some embodiments, the pharmaceutical composition includes an adjuvant.

The present invention also relates to a method for preventing, inhibiting, reducing, eliminating, protecting, and/or delaying the onset of an infection or an infectious clinical condition caused by a beta coronavirus in a subject, wherein the method includes administering to the subject at least one recombinant polypeptide of the invention or a pharmaceutical composition including the same.

The present invention further relates to a method for inducing an immune response against a coronavirus in a subject, wherein the method includes administering to the subject at least one recombinant polypeptide of the invention or a pharmaceutical composition including the same.

BRIEF DESCRIPTION OF THE DRAWINGS

FIG. 5C represents control samples including human serum from an individual prior to the emergence of SARS-CoV-2 (negative human serum sample) and the same serum spiked with a monoclonal antibody immunoreactive to the RBD portion of the Wuhan variant of the SARS-CoV-2 Spike protein. Infectivity of serum neutralized pseudotypes virus using 295T/ACE2 target cells was quantified by measuring NanoLuc luciferase activity (RLU) and graphed on the y-axis. Reciprocal serum dilution is shown on the x-axis.

DETAILED DESCRIPTION OF THE INVENTION

Figure 1:
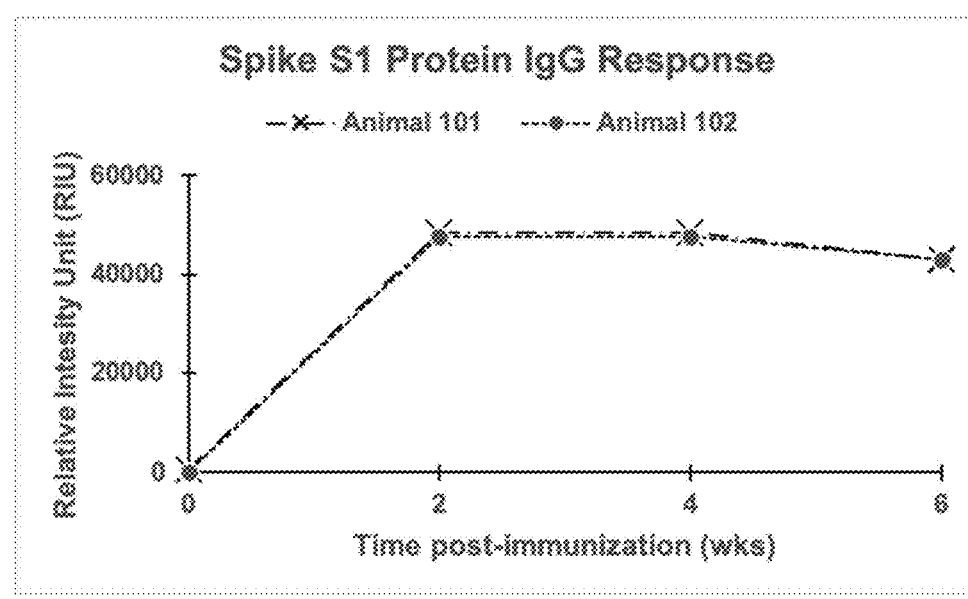
FIG. 1 is a graph depicting Spike 51 protein IgG response in Rhesus macaques at certain time points (in weeks) after initial injection with an exemplary construct.
Figure 2A:
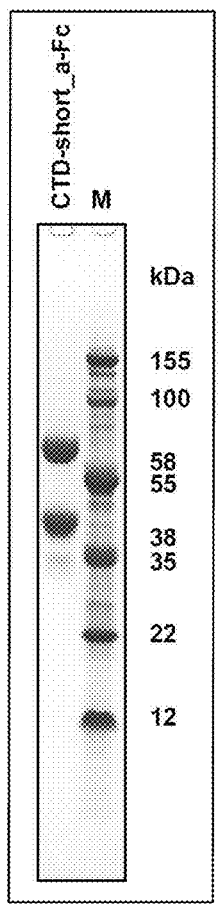
FIG. 2A is an image showing CHO cell expression of CTD_short_a-Fc (LS2330) after 5 days. Protein was affinity purified using Protein A agarose and analyzed by reducing SDS-PAGE and detected by Coomassie R-250 staining. M-Molecular weight markers. As can be seen in each of FIGS. 2A-2D, the constructs were resistant to proteolytic degradation during expression thus facilitating higher yields of intact, soluble protein
Figure 2B:
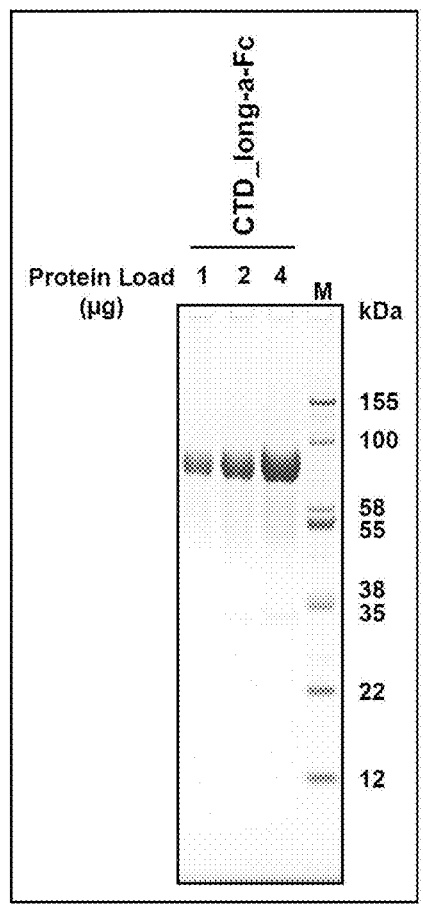
FIG. 2B is an image showing CHO cell expression of CTD_long_a-Fc (LS3472) after 5 days. Protein was affinity purified using Protein A agarose and analyzed by reducing SDS-PAGE and detected by Coomassie R-250 staining. Protein loads per lane are indicated.
Figure 2C:
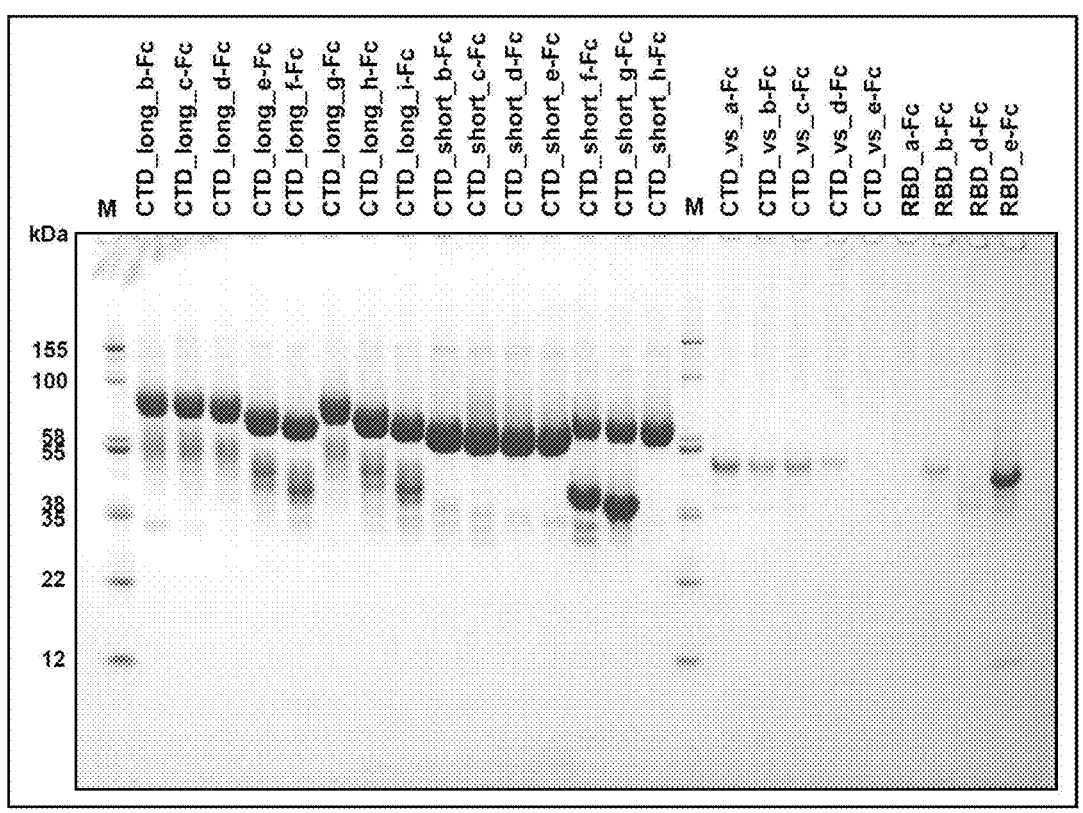
FIG. 2C is an image showing CHO cell expression of CTD-deletion series after 5 days. Protein was affinity purified using Protein A agarose from equal volumes of transfected culture. Eluted protein was loaded based on volume, separated by reducing SDS-PAGE, and detected by Coomassie R-250 staining. Load volumes were twice as large for samples (left to right) CTD_vs_a-Fc to RBD_e-Fc compared to the samples on the left of the gel (CTD_long_b-Fc to CTD_short_h-Fc).
Figure 2D:
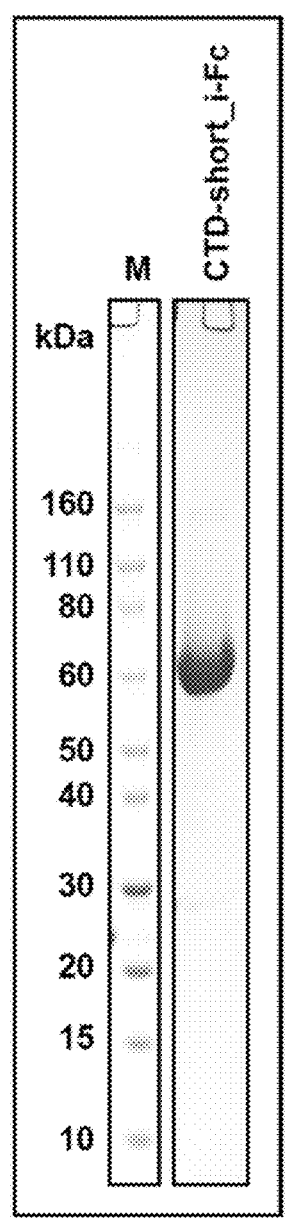
FIG. 2D is an image showing CHO cell expression of CTD_short_i-Fc (LS2371) after 5 days. Protein was affinity purified using Protein A agarose and analyzed by reducing SDS-PAGE and detected by Coomassie R-250 staining.

Recombinant polypeptides of the invention can include any suitable immunogenic fragment or fragments of the Severe Acute Respiratory Syndrome Coronavirus 2 (SARS-CoV-2) spike glycoprotein and optionally any suitable antibody Fc region. In some embodiments, an immunogenic fragment comprises, consist of, or consist essentially of, the N-terminal domain of the S1 subunit, the C-terminal domain of the S1 subunit, or both. In certain embodiments, an immunogenic fragment can include the complete SARS-CoV-2 spike glycoprotein. Recombinant polypeptides of the invention include at least one immunogenic fragment, and can contain two, three, four, five, six, seven, eight, nine, ten, eleven, twelve, thirteen, fourteen, fifteen, or more such immunogenic fragments.

In some embodiments, one or more of the immunogenic fragments are identical to a wild-type SARS-CoV-2 spike glycoprotein, or any portion thereof. Wild-type spike glycoproteins include those of any SARS-CoV-2 strain that has been isolated from a subject. Examples include Wuhan-Hu-1, VOC 202012/01/B.1.1.7 (Alpha or UK), VOC-202102/02 (B.1.1.7 with E484K) (UK), 501.V2/B.1.351 (South Africa), B.1.429/CAL.20C (California), B.1.525, and Lineage P.1 (Gamma or Brazil), B.1.427 (Epsilon), B.1.429 (Epsilon), B.1.617.1, B.1.617.2 (Delta), B.1.526 (Iota), B.1.617.3, B.1, A.2.5, C.36.3, B.1.1.318, B.1.351, B.1.621, B.1.525, P.1.1, P.2 (Zeta), B.1.623, R.1, B.1.1.7, B.1.351, B.1.351.3, B.1.351.3, BA.1, BA.1.1, BA.1.1.1, BA.1.1.2, BA.1.1.12, BA.1.1.13, BA.1.14, BA.1.15, BA.1.15.1, BA.1.16, BA1.17.2, BA.1.18, BA.2, BA.2+, BA.2.1, BA.2.10.1, BA.2.2, BA.2.3.2, BA.2.4, BA.2.5, BA2.6, BA.2.7, BA.2.8, BA.2.9, BA.2.10, BA2.12, BA.3, BA.4, BA.5, XA, XB, XC, XD, XE, XF, XG, XH, XJ, XK, XL, XM, XN, XP, XQ, XR, XS, and XT. In some embodiments, one or more of the immunogenic fragments are identical to a wild-type SARS-CoV or MERS spike glycoprotein, or any portion thereof. Wild-type SARS-CoV and MERS spike glycoproteins include those of any SARS-CoV or MERS strain that has been isolated from a subject. Examples of such strains include SARS coronavirus Tor2 (GenBank accession number NC 004718.3) and MERS coronavirus (GenBank accession number NC_019843.3).

In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to a wild-type SARS-CoV-2 spike glycoprotein, or any portion thereof. In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to a wild-type SARS-CoV or MERS spike glycoprotein, or any portion thereof.

In some embodiments, one or more of the immunogenic fragments are identical to a wild-type SARS-CoV-2 spike glycoprotein, or any portion thereof, except for at one or more of the following positions of the amino acid sequence: L5, A67, H69, V70, D80, T95, G142, Y144, E154, F157, D253, K417, L452, S477, T478, E484, N501, D614, Q677, P681, A701, T791, T859, F888, D950, and Q1071, wherein the positions of the listed amino acid residues correspond to the wild-type amino acid sequence QHD43416 (ncbi.nlm.nih.gov/protein/QHD43416). In some embodiments, one or more of the immunogenic fragments are identical to a wild-type SARS-CoV-2 spike glycoprotein, or any portion thereof, except for at one or more of the following positions of the amino acid sequence: L5, A67, H69, V70, D80, T95, G142, Y144, E154, F157, D253, G339, R346, 5371, 5373, 5375, T376, D405, R408, K417, N440, G446, L452, S477, T478, E484, Q493, G496, Q498, N501, Y505, T547, D614, Q677, P681, A701, T791, T859, F888, D950, and Q1071, wherein the positions of the listed amino acid residues correspond to the wild-type amino acid sequence QHD43416 (ncbi.nlm.nih.gov/protein/QHD43416). In certain embodiments, one or more of the immunogenic fragments comprises, consists of, or consists essentially of an amino acid sequence selected from SEQ ID NOs: 245-254, except for at one or more of the following positions of the amino acid sequence: L5, A67, H69, V70, D80, T95, G142, Y144, E154, F157, D253, G339, R346, 5371, S373, S375, T376, D405, R408, K417, N440, G446, L452, S477, T478, E484, Q493, G496, Q498, N501, Y505, T547, D614, Q677, P681, A701, T791, T859, F888, D950, and Q1071, wherein the positions of the listed amino acid residues correspond to the wild-type amino acid sequence QHD43416 (ncbi.nlm.nih.gov/protein/QHD43416). In certain embodiments, one or more of the immunogenic fragments comprises, consists of, or consists essentially of an amino acid sequence selected from SEQ ID NOs: 245-254, except for at one or more of the following positions of the amino acid sequence: G339, R346, 5371, 5373, 5375, T376, D405, R408, K417, N440, G446, L452, 5477, T478, E484, Q493, G496, Q498, N501, and Y505, wherein the positions of the listed amino acid residues correspond to the wild-type amino acid sequence QHD43416 (ncbi.nlm.nih.gov/protein/QHD43416). The mutations at these positions can be any suitable mutation, including conservative and non-conservative amino acid mutations. For instance, a conservative substitution can replace one aliphatic amino acid (i.e., Glycine, Alanine, Valine, Leucine, Methionine or Isoleucine) for another, one polar, uncharged R group amino acid (i.e., Serine, Cysteine, Threonine, Proline, Asparagine, or Methionine) for another, one positively charged R group amino acid (i.e., Histidine, Lysine, or Arginine) for another, one negatively charged R group amino acid (i.e., Aspartate or Glutamate) for another, and one non-polar, aromatic R group amino acid (i.e., Phenylalanine, Tyrosine, or Tryptophan) for another. In some embodiments, one or more of the immunogenic fragments are identical to a wild-type SARS-CoV-2 spike glycoprotein, or any portion thereof, except for one or more of the following amino acid substitutions and deletions: L5F, A67V, 69del, 70del, D80G, T95I, G142D, 144del, E154K, F157S, D253G, L452R, S477N, E484K, E484Q, K417N, K417T, T478K, N501Y, D614G, Q677H, T791I, P681H, P681R, A701V, F888L, T859N, D950H, D950N, and Q1071H, wherein the listed amino acid substitutions and deletions are relative to the wild-type amino acid sequence QHD43416 (ncbi.nlm.nih.gov/protein/

QHD43416). In one embodiment, the one or more amino acid substitutions and/or deletions is L452R. In another embodiment, the one or more amino acid substitutions and/or deletions is E484K. In a further embodiment, the one or more protein substitutions and/or deletions are K417N, E484K, and N501Y. In yet another embodiment, the one or more substitutions are and/or deletions are K417T, E484K, and N501Y. In another embodiment, the one or more amino acid substitutions and/or deletions are N501Y, 69del, 70del, and P681H. In another embodiment, the one or more amino acid substitutions and/or deletions are K417T, L452R, E484K, and N501Y.

In certain embodiments, one or more of the immunogenic fragment comprises, consists of, or consists essentially of an amino acid sequence with at least 90%, preferably at least 91%, 92%, 93%, 94%, 95%, 96%, 97%, 98%, or 99%, sequence identity to an amino acid sequence comprising, consisting of, or consisting essentially of a wild-type SARS-CoV-2 spike glycoprotein, or any portion thereof, wherein the amino acid sequence further comprises one or more of the following amino acid substitutions: G339D, R346K, S371F, S373P, S375F, T376A, D405N, R408S, K417N, N440K, G446S, L452R, S477N, T478K, E484A, E484K, Q493R, G496S, Q498R, N501Y, and Y505H to the extent the sequence does not already contain such residues. In some embodiments, one or more of the immunogenic fragments are identical to a wild-type SARS-CoV-2 spike glycoprotein, or any portion thereof, except for one or more of the following amino acid substitutions and deletions: L5F, A67V, 69del, 70del, D80G, T95I, G142D, 144del, E154K, F157S, D253G, G339D, R346K, S371F, S373P, S375F, T376A, D405N, R408S, N440K, G446S, L452R, S477N, E484A, E484K, E484Q, K417N, K417T, T478K, Q493R, G496S, Q498R, N501Y, Y505H, T547K, D614G, Q677H, T791I, P681H, P681R, A701V, F888L, T859N, D950H, D950N, and Q1071H, wherein the listed amino acid substitutions and deletions are relative to the wild-type amino acid sequence QHD43416 (ncbi.nlm.nih.gov/protein/QHD43416). In some embodiments, one or more of the immunogenic fragments comprises, consists of, or consists essentially of an amino acid sequence selected from SEQ ID NOs: 245-254, except for one or more of the following amino acid substitutions: G339D, R346K, S371F, S373P, S375F, T376A, D405N, R408S, K417N, N440K, G446S, L452R, S477N, T478K, E484A, E484K, Q493R, G496S, Q498R, N501Y, and Y505H, wherein the positions of the listed amino acid residues correspond to the wild-type amino acid sequence QHD43416 (ncbi.nlm.nih.gov/protein/QHD43416). In certain embodiments, one or more of the immunogenic fragment comprises, consists of, or consists essentially of an amino acid sequence with at least 90%, preferably at least 91%, 92%, 93%, 94%, 95%, 96%, 97%, 98%, or 99%, sequence identity to an amino acid sequence selected from SEQ ID NOs: 245-254, wherein the amino acid sequence further comprises one or more of the following amino acid substitutions: G339D, R346K, S371F, S373P, S375F, T376A, D405N, R408S, K417N, N440K, G446S, L452R, S477N, T478K, E484A, E484K, Q493R, G496S, Q498R, N501Y, and Y505H, to the extent the sequence does not already contain such residues.

In one embodiment, the one or more amino acid substitutions is G339D, R346K, T376A, D405N, R408S, K417N, N440K, L452R, S477N, T478K, E484A, Q493R, Q498R, N501Y, and Y505H. In another embodiment, the one or more amino acid substitutions is G339D, S373P, T376A, D405N, R408S, K417N, N440K, S477N, T478K, E484A, Q493R, Q498R, N501Y, and Y505H. In another embodiment, the one or more amino acid substitutions is G339D, S371F, S373P, S375F, T376A, D405N, R408S, K417N, N440K, S477N, T478K, E484A, Q493R, Q498R, N501Y, and Y505H. In another embodiment, the one or more amino acid substitutions is G339D, T376A, D405N, R408S, K417N, N440K, L452R, S477N, T478K, E484K, Q493R, Q498R, N501Y, and Y505H. In another embodiment, the one or more amino acid substitutions is G339D, S371F, S373P, S375F, T376A, D405N, R408S, K417N, N440K, L452R, S477N, T478K, E484K, Q493R, and N501Y. In another embodiment, the one or more amino acid substitutions is G339D, T376A, D405N, R408S, K417N, N440K, S477N, T478K, E484A, and N501Y. In another embodiment, the one or more amino acid substitutions is G339D, S371F, S373P, S375F, T376A, D405N, R408S, K417N, N440K, S477N, T478K, E484A, Q493R, Q498R, N501Y, and Y505H. In another embodiment, the one or more amino acid substitutions is G339D, S371F, K417N, N440K, G446S, S477N, T478K, E484A, Q493R, G496S, Q498R, N501Y, and Y505H. In another embodiment, the one or more amino acid substitutions is G339D, R346K, T376A, D405N, R408S, K417N, N440K, G446S, L452R, S477N, T478K, E484K, Q493R, G496S, Q498R, N501Y, and Y505H. In another embodiment, the one or more amino acid substitutions is G339D, S373P, T376A, D405N, R408S, K417N, N440K, S477N, T478K, E484A, Q493R, Q498R, N501Y, and Y505H.

The subject can be mammalian, including human, non-human primate, horse, pig, cattle, cat, dog, sheep, mink, rodent, hamster, or bat. Subjects can further include western lowland gorilla, northern white-cheeked gibbon, Sumatran orangutan, crab-eating macaque, drill, proboscis monkey, bonobo, chimpanzee, ugandan red colobus, red-shanked douc, golden snub-nosed monkey, green monkey, patas monkey, rhesus macaque, olive baboon, gelade, sooty mangabey, southern pig-tailed macaque, angola colobus, coquerel's sifaka, Gambian pouched rat, Chinese hamster, common gund, beluga whale, blue-eyed black lemur, indri, narwhal, narrow-ridged finless porpoise, harbour porpoise, minke whale, Antarctic minke whale, gray whale, spalax, white-tailed deer, reindeer, southern tamandua, Stephens's kangaroo rat, Pere David's deer, transcaucasian mole vole, long-finned pilot whale, Pacific white-sided dolphin, baiji, giant anteater, muskrat, killer whale, common bottlenose dolphin, aye-aye, fat-tailed dwarf lemur, thirteen-lined ground squirrel, yellow-bellied marmot, alpine marmot, golden hamster, sperm whale, daurian ground squirrel, gobi jerboa, barbry sheep, pronghorn, Nancy ma's night monkey, hirola, American bison, zebu, wild yak, cattle, water buffalo, white-eared titi, common marmoset, wild goat, goat, Panamanian white-faced capuchin, cat, Masai giraffe, Nilgiri tahr, Candian lynx, coquerel's giant mouse lemur, Siberian musk deer, sunda clouded leopard, clouded leopard, okapi, sheep, jaguar, leopard, Siberian tiger, Tibetan antelope, little pocket mouse, deer mouse, white-faced saki, cougar, black-capped squirrel monkey, tufted capuchin, arctic ground squirrel, *bos indicus×bos Taurus*, cheetah, mantled howler, Geoffroy's spider monkey, Damaraland mole-rat, naked mole-rat, hippopotamus, snowshoe hare, Dama gazelle, European rabbit, scimitar oryx, emperor tamarin, and alpaca.

In some embodiments, one or more of the immunogenic fragments contain one or more mutations, such that the one or more immunogenic fragments are not identical to a wild-type SARS-CoV-2 spike glycoprotein, or any portion thereof. The one or more mutations can be any suitable mutation and/or deletion, such as those disclosed herein. For example, an immunogenic fragment can contain sequences from two, three, four, five, six, seven, eight, nine, ten, or more strains, such that the resulting fragment is no longer identical to any of its parent strains. In this way, a single immunogenic fragment can present epitopes from multiple wild-type SARS-CoV-2 spike glycoproteins, or any portion thereof. This can lead to a more robust immune response and increased immune protection from a range of SARS-CoV-2 strains in a subject when a recombinant polypeptide of the invention containing one or more such immunogenic fragments, or a pharmaceutical composition containing the same, is administered to the subject.

In some embodiments, the nucleic acid sequence encoding an immunogenic fragment includes one, two, three, four, five, six, seven, eight, nine, ten, twenty, thirty, forty, or more point mutations and/or deletions in comparison to the nucleic acid sequence encoding the corresponding fragment of a wild-type or mutant glycoprotein. In some embodiments, the amino acid sequence of an immunogenic fragment includes one, two, three, four, five, six, seven, eight, nine, ten, twenty, thirty, forty, or more substitutions and/or deletions in comparison to the amino acid sequence encoding corresponding fragment of a wild-type or mutant glycoprotein.

In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 1 (CTD_long_a), SEQ ID NO: 3 (CTD_long_a D614G), SEQ ID NO: 5 (CTD_long_a-Dimer), SEQ ID NO: 7 (CTD_long_b), SEQ ID NO: 9 (CTD_long_c), SEQ ID NO: 11 (CTD_long_d), SEQ ID NO: 13 (CTD_long_e), SEQ ID NO: 15 (CTD_long_f), SEQ ID NO: 17 (CTD_long_g), SEQ ID NO: 19 (CTD_long_h), SEQ ID NO: 21 (CTD_long_i), SEQ ID NO: 23 (CTD_short_a), SEQ ID NO: 25 (CTD_short_b), SEQ ID NO: 27 (CTD_short_c), SEQ ID NO: 29 (CTD_short_d), SEQ ID NO: 31 (CTD_short_e), SEQ ID NO: 33 (CTD_short_f), SEQ ID NO: 35 (CTD_short_g), SEQ ID NO: 37 (CTD_short_h), SEQ ID NO: 39 (CTD_short_i), SEQ ID NO: 41 (CTD_vs_a), SEQ ID NO: 43 (CTD_vs_b), SEQ ID NO: 45 (CTD_vs_c), SEQ ID NO: 47 (CTD_vs_d), SEQ ID NO: 49 (CTD_vs_e), SEQ ID NO: 51 (RBD_a), SEQ ID NO: 53 (RBD_b), SEQ ID NO: 55 (RBD_c), SEQ ID NO: 57 (RBD_d), SEQ ID NO: 59 (RBD_e), SEQ ID NO: 61 (NTD_long_a), SEQ ID NO: 63 (NTD_short_a), SEQ ID NO: 171 (RBD-tight), SEQ ID NO: 173 ((RBD-tight)$_2$), SEQ ID NO: 175 (RBD-extended), SEQ ID NO: 177 ((RBD-extended)$_2$), SEQ ID NO: 179 (RBD), SEQ ID NO: 181 ((RBD)$_2$), SEQ ID NO: 183 ((CTD_short_d)$_2$), SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), SEQ ID NO: 191 ((CTD_short_i)$_2$—mod. 3), SEQ ID NO: 199 (SARS-2003, SARS_short_h), SEQ ID NO: 201 (SARS-2003, SARS_short_i), SEQ ID NO: 203 (MERS_Lytic_a), SEQ ID NO: 205 (MERS_Lytic_b), SEQ ID NO: 207 (MERS_Lytic_c), SEQ ID NO: 209 (MERS_Lytic_d), SEQ ID NO: 211 (MERS_Lytic_e), SEQ ID NO: 213 (MERS_Lytic_f), SEQ ID NO: 215 (MERS_Lytic_g), SEQ ID NOs: 245-254 (BA.X-1-BA.X-10), and SEQ ID NOs: 265-274 (BA.X-1-dimer-BA.X-10-dimer). In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), and SEQ ID NO: 191 ((CTD_short_i)$_2$—mod. 3). In further embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence of SEQ ID NO: 185 ((CTD_short_i)$_2$). In further embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 183 ((CTD_short_d)$_2$), SEQ ID NO: 39 (CTD_short_i), SEQ ID NO: 29 (CTD_short_d), SEQ ID NO: 31 (CTD_short_e), SEQ ID NO: 37 (CTD_short_h), and SEQ ID NO: 23 (CTD_short_a). In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 39. In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 185. In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 190. In some embodiments, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence selected from SEQ ID NOs: 245-254 (BA.X-1-BA.X-10). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 245 (BA.X-1). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 246 (BA.X-2). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 247 (BA.X-3). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 248 (BA.X-4). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 249 (BA.X-5). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 250 (BA.X-6). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 251 (BA.X-7). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 252 (BA.X-8). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 253 (BA.X-9). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 254 (BA.X-10). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 265 (BA.X-1-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 266 (BA.X-2-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 267 (BA.X-3-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 268 (BA.X-4-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 269 (BA.X-5-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 270 (BA.X-6-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 271 (BA.X-7-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 272 (BA.X-8-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 273 (BA.X-9-dimer). In an embodiment, an immunogenic fragment comprises, consists of, or consists essentially of an amino acid sequence with at least 90%, preferably at least 91%, 92%, 93%, 94%, 95%, 96%, 97%, 98%, or 99%, sequence identity to the amino acid sequence represented by SEQ ID NO: 274 (BA.X-10-dimer).

In some embodiments, the recombinant polypeptide comprises at least one immunogenic fragment that comprises, consists of, or consists essentially of an amino acid sequence selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 171, 173, 175, 177, 179, 181, 183, 185, 187, 189, 191, 199, 201, 203, 205, 207, 209, 211, 213, 215, 245-254, and 265-274. In some embodiments, an immunogenic fragment comprises, consists of, or consists essentially of an amino acid sequence selected from the group consisting of SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), and SEQ ID NO: 191 ((CTD_short_i)$_2$—mod. 3). In an embodiment, an immunogenic fragment comprises, consists of, or consists essentially of the amino acid sequence represented by SEQ ID NO: 185. In an embodiment, an immunogenic fragment comprises, consists of, or consists essentially of the amino acid sequence represented by SEQ ID NO: 191. In further embodiments an immunogenic fragment comprises, consists of, or consists essentially of the amino acid sequence of SEQ ID NO: 185 ((CTD_short_i)$_2$). In further embodiments, an immunogenic fragment comprises, consists of, or consists essentially of an amino acid sequence selected from the group consisting of SEQ ID NO: 183 ((CTD_short_d)$_2$), SEQ ID NO: 39 (CTD_short_i), SEQ ID NO: 29 (CTD_short_d), SEQ ID NO: 31 (CTD_short_e), SEQ ID NO: 37 (CTD_short_h), and SEQ ID NO: 23 (CTD_short_a). In some embodiments, the recombinant polypeptide comprises at least one immunogenic fragment that comprises, consists of, or consists essentially of an amino acid sequence selected from the group consisting of SEQ ID NOS: 245-254 and 265-274. In some embodiments, the recombinant polypeptide comprises at least one immunogenic fragment that comprises, consists of, or consists essentially of an amino acid sequence selected from the group consisting of SEQ ID NOS: 245-254. In some embodiments, the recombinant polypeptide comprises at least one immunogenic fragment that comprises, consists of, or consists essentially of an amino acid sequence represented by SEQ ID NO: 245. In some embodiments, the recombinant polypeptide comprises at least one immunogenic fragment that comprises, consists of, or consists essentially of an amino acid sequence represented by SEQ ID NO: 246. In some embodiments, the recombinant polypeptide comprises at least one immunogenic fragment that comprises, consists of, or consists essentially of an amino acid sequence represented by SEQ ID NO: 247. In some embodiments, the recombinant polypeptide comprises at least one immunogenic fragment that comprises, consists of, or consists essentially of an amino acid sequence represented by SEQ ID NO: 248. In some embodiments, the recombinant polypeptide comprises at least one immunogenic fragment that comprises, consists of, or consists essentially of an amino acid sequence represented by SEQ ID NO: 249. In some embodiments, the recombinant polypeptide comprises at least one immunogenic fragment that comprises, consists of, or consists essentially of an amino acid sequence represented by SEQ ID NO: 250. In some embodiments, the recombinant polypeptide comprises at least one immunogenic fragment that comprises, consists of, or consists essentially of an amino acid sequence represented by SEQ ID NO: 251. In some embodiments, the recombinant polypeptide comprises at least one immunogenic fragment that comprises, consists of, or consists essentially of an amino acid sequence represented by SEQ ID NO: 252. In some embodiments, the recombinant polypeptide comprises at least one immunogenic fragment that comprises, consists of, or consists essentially of an amino acid sequence represented by SEQ ID NO: 253. In some embodiments, the recombinant polypeptide comprises at least one immunogenic fragment that comprises, consists of, or consists essentially of an amino acid sequence represented by SEQ ID NO: 254. In some embodiments, the recombinant polypeptide comprises at least one immunogenic fragment that comprises, consists of, or consists essentially of an amino acid sequence represented by SEQ ID NO: 265. In some embodiments, the recombinant polypeptide comprises at least one immunogenic fragment that comprises, consists of, or consists essentially of an amino acid sequence represented by SEQ ID NO: 266. In some embodiments, the recombinant polypeptide comprises at least one immunogenic fragment that comprises, consists of, or consists essentially of an amino acid sequence represented by SEQ ID NO: 267. In some embodiments, the recombinant polypeptide comprises at least one immunogenic fragment that comprises, consists of, or consists essentially of an amino acid sequence represented by SEQ ID NO: 268. In some embodiments, the recombinant polypeptide comprises at least one immunogenic fragment that comprises, consists of, or consists essentially of an amino acid sequence represented by SEQ ID NO: 269. In some embodiments, the recombinant polypeptide comprises at least one immunogenic fragment that comprises, consists of, or consists essentially of an amino acid sequence represented by SEQ ID NO: 270. In some embodiments, the recombinant polypeptide comprises at least one immunogenic fragment that comprises, consists of, or consists essentially of an amino acid sequence represented by SEQ ID NO: 271. In some embodiments, the recombinant polypeptide comprises at least one immunogenic fragment that comprises, consists of, or consists essentially of an amino acid sequence represented by SEQ ID NO: 272. In some embodiments, the recombinant polypeptide comprises at least one immunogenic fragment that comprises, consists of, or consists essentially of an amino acid sequence represented by SEQ ID NO: 273. In some embodiments, the recombinant polypeptide comprises at least one immunogenic fragment that comprises, consists of, or consists essentially of an amino acid sequence represented by SEQ ID NO: 274.

In some embodiments, the recombinant polypeptide comprises at least one immunogenic fragment that is encoded by a nucleotide sequence that comprises, consists of, or consists essentially of a nucleotide sequence selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 172, 174, 176, 178, 180, 182, 184, 186, 188, 190, 192, 200, 202, 204, 206, 208, 210, 212, 214, 216, 285-294, and 305-314. In some embodiments, the recombinant polypeptide includes at least two immunogenic fragments. For example, the recombinant polypeptide can include two, three, four, five, six, seven, eight, nine, ten, or more immunogenic fragments. In some embodiments, the recombinant polypeptide includes at least three immunogenic fragments. In some embodiments, the recombinant polypeptide includes at least three immunogenic fragments, of which at least one is a SARS-CoV-2 spike glycoprotein fragment as described herein, at least one is a SARS-CoV spike glycoprotein fragment as described herein, and at least one is a MERS-CoV spike glycoprotein fragment as described herein. In some embodiments, the recombinant polypeptide includes at least three immunogenic fragments, of which at least one is a SARS-CoV-2 spike glycoprotein fragment, wherein the SARS-CoV-2 fragment comprises, consists of, or consists essentially of an amino acid sequence with at least 90%, preferably at least 95%, 96%, 97%, 98%, or 99%, sequence identity to an amino acid sequence selected from the group consisting of SEQ ID NO: 1 (CTD_long_a), SEQ ID NO: 3 (CTD_long_a D614G), SEQ ID NO: 5 (CTD_long_a-Dimer), SEQ ID NO: 7 (CTD_long_b), SEQ ID NO: 9 (CTD_long_c), SEQ ID NO: 11 (CTD_long_d), SEQ ID NO: 13 (CTD_long_e), SEQ ID NO: 15 (CTD_long_f), SEQ ID NO: 17 (CTD_long_g), SEQ ID NO: 19 (CTD_long_h), SEQ ID NO: 21 (CTD_long_i), SEQ ID NO: 23 (CTD_short_a), SEQ ID NO: 25 (CTD_short_b), SEQ ID NO: 27 (CTD_short_c), SEQ ID NO: 29 (CTD_short_d), SEQ ID NO: 31 (CTD_short_e), SEQ ID NO: 33 (CTD_short_f), SEQ ID NO: 35 (CTD_short_g), SEQ ID NO: 37 (CTD_short_h), SEQ ID NO: 39 (CTD_short_i), SEQ ID NO: 41 (CTD_vs_a), SEQ ID NO: 43 (CTD_vs_b), SEQ ID NO: 45 (CTD_vs_c), SEQ ID NO: 47 (CTD_vs_d), SEQ ID NO: 49 (CTD_vs_e), SEQ ID NO: 51 (RBD_a), SEQ ID NO: 53 (RBD_b), SEQ ID NO: 55 (RBD_c), SEQ ID NO: 57 (RBD_d), SEQ ID NO: 59 (RBD_e), SEQ ID NO: 61 (NTD_long_a), SEQ ID NO: 63 (NTD_short_a), SEQ ID NO: 171 (RBD-tight), SEQ ID NO: 173 ((RBD-tight)$_2$), SEQ ID NO: 175 (RBD-extended), SEQ ID NO: 177 ((RBD-extended)$_2$), SEQ ID NO: 179 (RBD), SEQ ID NO: 181 ((RBD)$_2$), SEQ ID NO: 183 ((CTD_short_d)$_2$), SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), SEQ ID NO: 191 ((CTD_short_i)$_2$—mod. 3), SEQ ID NOs: 245-254 (BA.X-1-BA.X-10), and SEQ ID NOs: 265-274 (BA.X-1-dimer-BA.X-10-dimer); at least one is a SARS-CoV spike glycoprotein fragment, wherein the SARS-CoV fragment comprises, consists of, or consists essentially of an amino acid sequence with at least 90%, preferably at least 91%, 92%, 93%, 94%, 95%, 96%, 97%, 98%, or 99%, sequence identity to an amino acid sequence represented by SEQ ID NO: 199 (SARS-2003, SARS_short_h), or SEQ ID NO: 201 (SARS-2003, SARS_short_i); and at least one is a MERS-CoV spike glycoprotein fragment, wherein the MERS-CoV fragment comprises, consists of, or consists essentially of an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 203 (MERS_Lytic_a), SEQ ID NO: 205 (MERS_Lytic_b), SEQ ID NO: 207 (MERS_Lytic_c), SEQ ID NO: 209 (MERS_Lytic_d), SEQ ID NO: 211 (MERS_Lytic_e), SEQ ID NO: 213 (MERS_Lytic_f), and SEQ ID NO: 215 (MERS_Lytic_g).

In some embodiments, the recombinant polypeptide includes at least two immunogenic fragments, wherein each of the at least two immunogenic fragments comprises, consists of, or consists essentially of, an amino acid sequence with at least 90%, preferably at least 91%, 92%, 93%, 94%, 95%, 96%, 97%, 98%, or 99%, sequence identity to an amino acid sequence independently selected from the group consisting of SEQ ID NO: 1 (CTD_long_a), SEQ ID NO: 3 (CTD_long_a D614G), SEQ ID NO: 5 (CTD_long_a-Dimer), SEQ ID NO: 7 (CTD_long_b), SEQ ID NO: 9

(CTD_long_c), SEQ ID NO: 11 (CTD_long_d), SEQ ID NO: 13 (CTD_long_e), SEQ ID NO: 15 (CTD_long_f), SEQ ID NO: 17 (CTD_long_g), SEQ ID NO: 19 (CTD_long_h), SEQ ID NO: 21 (CTD_long_i), SEQ ID NO: 23 (CTD_short_a), SEQ ID NO: 25 (CTD_short_b), SEQ ID NO: 27 (CTD_short_c), SEQ ID NO: 29 (CTD_short_d), SEQ ID NO: 31 (CTD_short_e), SEQ ID NO: 33 (CTD_short_f), SEQ ID NO: 35 (CTD_short_g), SEQ ID NO: 37 (CTD_short_h), SEQ ID NO: 39 (CTD_short_i), SEQ ID NO: 41 (CTD_vs_a), SEQ ID NO: 43 (CTD_vs_b), SEQ ID NO: 45 (CTD_vs_c), SEQ ID NO: 47 (CTD_vs_d), SEQ ID NO: 49 (CTD_vs_e), SEQ ID NO: 51 (RBD_a), SEQ ID NO: 53 (RBD_b), SEQ ID NO: 55 (RBD_c), SEQ ID NO: 57 (RBD_d), SEQ ID NO: 59 (RBD_e), SEQ ID NO: 61 (NTD_long_a), SEQ ID NO: 63 (NTD_short_a), SEQ ID NO: 171 (RBD-tight), SEQ ID NO: 173 ((RBD-tight)$_2$), SEQ ID NO: 175 (RBD-extended), SEQ ID NO: 177 ((RBD-extended)$_2$), SEQ ID NO: 179 (RBD), SEQ ID NO: 181 ((RBD)$_2$), SEQ ID NO: 183 ((CTD_short_d)$_2$), SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), SEQ ID NO: 191 ((CTD_short_i)$_2$—mod. 3), SEQ ID NOs: 245-254 (BA.X-1-BA.X-10), and SEQ ID NOs: 265-274 (BA.X-1-dimer-BA.X-10-dimer). In some embodiments, each of the at least two immunogenic fragments comprises, consists of, or consists essentially of an amino acid sequence with at least 90%, preferably at least 91%, 92%, 93%, 94%, 95%, 96%, 97%, 98%, or 99%, sequence identity to an amino acid sequence independently selected from the group consisting of SEQ ID NO: 183 ((CTD_short_d)$_2$), SEQ ID NO: 39 (CTD_short_i), SEQ ID NO: 29 (CTD_short_d), SEQ ID NO: 31 (CTD_short_e), SEQ ID NO: 37 (CTD_short_h), SEQ ID NO: 23 (CTD_short_a), and SEQ ID NOs: 245-254 (BA.X-1-BA.X-10). In some embodiments, each of the at least two immunogenic fragments comprises, consists of, or consists essentially of an amino acid sequence with at least 90%, preferably at least 91%, 92%, 93%, 94%, 95%, 96%, 97%, 98%, or 99%, sequence identity to the amino acid sequence of SEQ ID NO: 39 (CTD_short_i). In further embodiments, each of the at least two immunogenic fragments comprises, consists of, or consists essentially of an amino acid sequence independently selected from the group consisting of SEQ ID NO: 183 ((CTD_short_d)$_2$), SEQ ID NO: 39 (CTD_short_i), SEQ ID NO: 29 (CTD_short_d), SEQ ID NO: 31 (CTD_short_e), SEQ ID NO: 37 (CTD_short_h), SEQ ID NO: 23 (CTD_short_a),), SEQ ID NOs: 245-254 (BA.X-1-BA.X-10), and SEQ ID NOs: 265-274 (BA.X-1-dimer-BA.X-10-dimer). In further embodiments, each of the at least two immunogenic fragments comprises, consists of, or consists essentially of the amino acid sequence of SEQ ID NO: 39 (CTD_short_i). In further embodiments, each of the at least two immunogenic fragments comprises, consists of, or consists essentially of an amino acid sequence independently selected from the group consisting of SEQ ID NOs: 245-254 (BA.X-1-BA.X-10), and SEQ ID NOs: 265-274 (BA.X-1-dimer-BA.X-10-dimer). In further embodiments, each of the at least two immunogenic fragments comprises, consists of, or consists essentially of an amino acid sequence independently selected from the group consisting of SEQ ID NOs: 245-254 (BA.X-1-BA.X-10). The at least two immunogenic fragments can comprise, consist of, or consist essentially of, any suitable combination of amino acid sequences.

In certain embodiments, each of the at least two immunogenic fragments comprise, consist of, or consist essentially of the same amino acid sequence selected from the group consisting of SEQ ID NOs: 245-254 (BA.X-1-BA.X-10), e.g., the at least two immunogenic fragments each comprise, consist of, or consist essentially of an amino acid sequence represented by SEQ ID NO: 245. In another embodiment, the at least two immunogenic fragments each comprise, consist of, or consist essentially of SEQ ID NO: 246. In another embodiment, the at least two immunogenic fragments each comprise, consist of, or consist essentially of an amino acid sequence represented by SEQ ID NO: 247. In another embodiment, the at least two immunogenic fragments each comprise, consist of, or consist essentially of an amino acid sequence represented by SEQ ID NO: 248. In another embodiment, the at least two immunogenic fragments each comprise, consist of, or consist essentially of an amino acid sequence represented by SEQ ID NO: 249. In another embodiment, the at least two immunogenic fragments each comprise, consist of, or consist essentially of an amino acid sequence represented by SEQ ID NO: 250. In another embodiment, the at least two immunogenic fragments each comprise, consist of, or consist essentially of an amino acid sequence represented by SEQ ID NO: 251. In another embodiment, the at least two immunogenic fragments each comprise, consist of, or consist essentially of an amino acid sequence represented by SEQ ID NO: 252. In another embodiment, the at least two immunogenic fragments each comprise, consist of, or consist essentially of an amino acid sequence represented by SEQ ID NO: 253. In another embodiment, the at least two immunogenic fragments each comprise, consist of, or consist essentially of an amino acid sequence represented by SEQ ID NO: 254. In another embodiment, the at least two immunogenic fragments each comprise, consist of, or consist essentially of an amino acid sequence represented by SEQ ID NO: 265. In another embodiment, the at least two immunogenic fragments each comprise, consist of, or consist essentially of an amino acid sequence represented by SEQ ID NO: 266. In another embodiment, the at least two immunogenic fragments each comprise, consist of, or consist essentially of an amino acid sequence represented by SEQ ID NO: 267. In another embodiment, the at least two immunogenic fragments each comprise, consist of, or consist essentially of an amino acid sequence represented by SEQ ID NO: 268. In another embodiment, the at least two immunogenic fragments each comprise, consist of, or consist essentially of an amino acid sequence represented by SEQ ID NO: 269. In another embodiment, the at least two immunogenic fragments each comprise, consist of, or consist essentially of an amino acid sequence represented by SEQ ID NO: 270. In another embodiment, the at least two immunogenic fragments each comprise, consist of, or consist essentially of an amino acid sequence represented by SEQ ID NO: 271. In another embodiment, the at least two immunogenic fragments each comprise, consist of, or consist essentially of an amino acid sequence represented by SEQ ID NO: 272. In another embodiment, the at least two immunogenic fragments each comprise, consist of, or consist essentially of an amino acid sequence represented by SEQ ID NO: 273. In another embodiment, the at least two immunogenic fragments each comprise, consist of, or consist essentially of an amino acid sequence represented by SEQ ID NO: 274.

In certain embodiments, each of the at least two immunogenic fragments comprise, consist of, or consist essentially of a different amino acid sequence independently selected from the group consisting of SEQ ID NOs: 245-254 (BA.X-1-BA.X-10), e.g., when the recombinant polypeptide comprises, consists of, or consists essentially of two immunogenic fragments, one immunogenic fragment comprises, consists of, or consists essentially of SEQ ID NO: 245 and the second immunogenic fragment comprises, consists of, or consists essentially of an amino acid sequence selected from the group consisting of SEQ ID NOs: 246-254.

In some embodiments, the recombinant polypeptide includes a plurality of identical immunogenic fragments. For example, a recombinant polypeptide can include two, three, four, five, six, seven, eight, nine, ten, or more immunogenic fragments, wherein each fragment comprises, consists of, or consists essentially of the same amino acid sequence. In some embodiments, the recombinant polypeptide includes two, three, four or five identical immunogenic fragments. In yet further embodiments, the recombinant polypeptide includes two or three identical immunogenic fragments.

In some embodiments, the recombinant polypeptide includes a plurality of non-identical immunogenic fragments. For example, a recombinant polypeptide can include two, three, four, five, six, seven, eight, nine, ten, or more immunogenic fragments, wherein each fragment comprises, consists of, or consists essentially of a different amino acid sequence from each other fragment, i.e., each fragment is a different fragment. In some embodiments, the recombinant polypeptide includes two, three, four or five different immunogenic fragments. In yet further embodiments, the recombinant polypeptide includes two or three different immunogenic fragments.

In some embodiments, the recombinant polypeptide includes a plurality of immunogenic fragments, in which some of the fragments are identical, but not all. For example, a recombinant polypeptide can include two, three, four, five, six, seven, eight, nine, ten, or more immunogenic fragments, wherein each fragment comprises, consists of, or consists essentially of the same amino acid sequence, while also including one, two, three, four, five, six, seven, eight, nine, ten, or more immunogenic fragments, wherein each fragment comprises, consists of, or consists essentially of a different amino acid sequence from each other fragment. In some embodiments, the recombinant polypeptide includes a total of two, three, four or five immunogenic fragments. In yet further embodiments, the recombinant polypeptide includes a total of two or three immunogenic fragments.

In certain embodiments wherein the recombinant polypeptide comprises an antibody Fc region, the at least one immunogenic fragment can be arranged in any suitable serial orientation with respect to the Fc region. In some embodiments, the at least one immunogenic fragment is connected to the N-terminus of the Fc region. This orientation can be depicted as [immunogenic fragment]x-[N-terminus-Fc region-C-terminus], wherein X is an integer 1-10 representing the number of immunogenic fragments within the recombinant polypeptide. In some embodiments, the at least one immunogenic fragment is connected to the C-terminus of the Fc region. This orientation can be depicted as [N-terminus-Fc region-C-terminus]-[immunogenic fragment]x, wherein X is an integer 1-10 representing the number of immunogenic fragments within the recombinant polypeptide. In some embodiments, wherein the recombinant polypeptide includes at least two immunogenic fragments, at least one immunogenic fragment is connected to the N-terminus of the Fc region, and at least one immunogenic fragment is connected to the C-terminus of the Fc region. This orientation can be depicted as [immunogenic fragment]x-[N-terminus-Fc region-C-terminus]-[immunogenic fragment]y, wherein X and Y are independently an integer 1-10 representing the number of immunogenic fragments connected to each side of the Fc region. In some embodiments, wherein the recombinant polypeptide includes two immunogenic fragments, both immunogenic fragments are connected to the N-terminus of the Fc region. This orientation can be depicted as [immunogenic fragment]-[immunogenic fragment]-[N-terminus-Fc region-C-terminus]. In other embodiments, wherein the recombinant polypeptide includes two immunogenic fragments, both immunogenic fragments are connected to the C-terminus of the Fc region. This orientation can be depicted as [N-terminus-Fc region-C-terminus]-[immunogenic fragment]-[immunogenic fragment]. In some embodiments, wherein the recombinant polypeptide includes three immunogenic fragments, each immunogenic fragment is connected to the N-terminus of the Fc region. This orientation can be depicted as [immunogenic fragment]-[immunogenic fragment]-[immunogenic fragment]-[N-terminus-Fc region-C-terminus]. In other embodiments, wherein the recombinant polypeptide includes three immunogenic fragments, each immunogenic fragment is connected to the C-terminus of the Fc region. This orientation can be depicted as [N-terminus-Fc region-C-terminus]-[immunogenic fragment]-[immunogenic fragment]-[immunogenic fragment].

Embodiments of the recombinant polypeptide that include a plurality of immunogenic fragments provide for a flexible expression platform with robust expression of full-length protein, modality to modify individual or multiple domains within one or more of the plurality of immunogenic fragments to reflect the most recent virus variant sequence(s), allow for single step affinity purification by use of an Fc region if present in the recombinant polypeptide, and provide high-level, long-term immune response as tested in Rhesus macaques.

In some embodiments, wherein the recombinant polypeptide includes a plurality of immunogenic fragments, the immunogenic fragments are connected to each other via a linker. The linker can be any suitable linker. Suitable linkers include a polypeptide comprising, consisting of, or consisting essentially of, an amino acid sequence of 1-35 residues, wherein each residue is independently serine, glycine, or aspartic acid, and further wherein the amino acid sequence contains zero or one aspartic acid residues. Other suitable linkers include a polypeptide comprising an amino acid sequence selected from the group consisting of SEQ ID NO: 65 (Fc1), SEQ ID NO: 67 (Fc1-TEV), SEQ ID NO: 69 (Fc1-Rv3C), SEQ ID NO: 193 (Short), SEQ ID NO: 195 (Medium), and SEQ ID NO: 197 (Long). When a recombinant polypeptide includes two or more such linkers, the amino acid sequence of the linkers can be identical or different. In some embodiments, wherein the recombinant polypeptide includes a plurality of immunogenic fragments, the immunogenic fragments are connected directly to each other without an intervening linker.

In some embodiments, the recombinant polypeptide comprising or consisting essentially of one or more immunogenic fragments further comprises an antibody Fc region. In some embodiments, the recombinant polypeptide comprising, consisting of, or consisting essentially of one or more immunogenic fragments does not comprise an antibody Fc region. In some embodiments, the recombinant polypeptide comprising or consisting essentially of the one or more immunogenic fragments initially comprises an antibody Fc region, e.g., the recombinant polypeptide comprises an antibody Fc region upon expression of the recombinant polypeptide, wherein the antibody Fc region is subsequently removed, for instance, enzymatically removed. Suitable enzymes include, but are not limited to, class I proteases such as IdeS and IdeZ, and class II enzymes such as the Tobacco Etch Virus (TEV), Rhinovirus 3C (Rv3C), and Factor Xa. When a class II enzyme is employed, the recombinant polypeptide comprises the cleavage site for the employed enzyme. In some embodiments, the cleavage site is within or adjacent to the linker region between the Spike protein subunit and the Fc domain.

In some embodiments, removal occurs during a purification step or after the recombinant polypeptide has undergone at least one purification step. For instance, the purification is any suitable type of affinity purification, such as Protein A, Protein G, or Protein M purification. In some embodiments, subtractive chromatography steps are used to remove the enzyme. In subtractive chromatography, unwanted proteins are retained on the resin whilst desired proteins flow-through and are collected for further uses. Examples of suitable subtractive chromatography methods include IMAC for His6-tagged enzymes, and Protein A resin, Protein G resin, or Protein M resin to remove Fc-fusion enzymes. In some embodiments, cut Fcs and uncut Fc-fusions protein are removed by one or more of Protein A, Protein G, and Protein M resin chromatography.

In some embodiments, the one or more immunogenic fragments are connected to the antibody Fc region via a linker. The linker can be any suitable linker. Suitable linkers include a polypeptide comprising an amino acid sequence of 1-35 residues, wherein each residue is independently serine, glycine, or aspartic acid, and further wherein the amino acid sequence contains zero or one aspartic acid residues. Other suitable linkers include a polypeptide comprising an amino acid sequence selected from the group consisting of SEQ ID NO: 65 (Fc1), SEQ ID NO: 67 (Fc1-TEV), SEQ ID NO: 69 (Fc1-Rv3C), SEQ ID NO: 193 (Short), SEQ ID NO: 195 (Medium), and SEQ ID NO: 197 (Long). When a recombinant polypeptide includes two or more such linkers, the amino acid sequence of the linkers can be identical or different from each other. In some embodiments, wherein the recombinant polypeptide includes at least one immunogenic fragment connected to the N-terminus of the Fc region, and/or at least one immunogenic fragment is connected to the C-terminus of the Fc region, the immunogenic fragment(s) nearest to the Fc region are connected directly to the Fc region without an intervening linker.

The antibody Fc region included in the recombinant polypeptide can be any suitable antibody Fc region. Suitable antibody Fc regions include wild-type human or other animal Immunoglobulin Fc regions such as IgG, IgA, IgD, IgE, IgM, and their respective subclasses, for example, human IgG1 Fc regions and Fc regions derived therefrom. Other suitable antibody Fc regions include mutant Fc regions that enhance or diminish Fc-receptor binding affinity to speed up or slow down uptake, respectively. In some embodiments, the antibody Fc region comprises the amino acid sequence of SEQ ID NO: 71.

In some embodiments, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 73 (LS2330 [CTD_short_a-Fc]), SEQ ID NO: 75 (LS3472, LS3473, LS3474 [CTD_long_a-Fc]), SEQ ID NO: 77 (LS3477 [CTD_short_a-TEV-Fc]), SEQ ID NO: 79 (LS3485 [CTD_long_a TEV-Fc]), SEQ ID NO: 81 (LS3489 [CTD_short_a_Rv3c-Fc]), SEQ ID NO: 83 (LS3497 [CTD_long_a-Rv3c-Fc], SEQ ID NO: 85 (LS2316, LS2317, LS2318, LS2319 [CTD_long_a-His8]), SEQ ID NO: 87 (LS3479 [NTD_short_a-TEV-Fc]), SEQ ID NO: 89 (LS3475 [NTD_long_a-TEV-Fc]), SEQ ID NO: 91 (LS3491 [NTD_short_a-Rv3c-Fc]), SEQ ID NO: 93 (LS3487 [NTD_long_a-Rv3C-Fc]), SEQ ID NO: 95 (LS2326 [NTD_long_a-Fc]), SEQ ID NO: 97 (LS2354 [CTD_long_a D614G-Fc]), SEQ ID NO: 99 (LS2355 [CTD_long_a-Dimer-Fc]), SEQ ID NO:101 (LS2356 [CTD_long_b-Fc]), SEQ ID NO: 103 (LS2357 [CTD_long_c-Fc]), SEQ ID NO: 105 (LS2358 [CTD_long_d-Fc]), SEQ ID NO: 107 (LS2359 [CTD_long_e-Fc]), SEQ ID NO: 109 (LS2360 [CTD_long_f-Fc]), SEQ ID NO: 111 (LS2361 [CTD_long_g-Fc]), SEQ ID NO: 113 (LS2362 [CTD_long_h-Fc]), SEQ ID NO: 115 (LS2363 [CTD_long_i-Fc]), SEQ ID NO: 117 (LS2364 [CTD_short_b-Fc]), SEQ ID NO: 119 (LS2365 [CTD_short_c-Fc]), SEQ ID NO: 121 (LS2366 [CTD_short_d-Fc]), SEQ ID NO: 123 (LS2367 [CTD_short_e-Fc]), SEQ ID NO: 125 (LS2368 [CTD_short_f-Fc]), SEQ ID NO: 127 (LS2369 [CTD_short_g-Fc]), SEQ ID NO: 129 (LS2370 [CTD_short_h-Fc]), SEQ ID NO: 131 (LS2371 [CTD_short_i-Fc]), SEQ ID NO: 133 (LS2372 [CTD_vs_a-Fc]), SEQ ID NO: 135 (LS2373 [CTD_vs_b-Fc]), SEQ ID NO: 137 (LS2374 [CTD_vs_c-Fc]), SEQ ID NO: 139 (LS2375 [CTD_vs_d-Fc]), SEQ ID NO: 141 (LS2376 [CTD_vs_e-Fc]), SEQ ID NO: 143 (LS2377 [RBD_a-Fc]), SEQ ID NO: 145 (LS2378 [RBD_b-Fc]), SEQ ID NO: 147 (LS2379 [RBD_c-Fc]), SEQ ID NO: 149 (LS2380 [RBD_d-Fc]), SEQ ID NO: 151 (LS2381 [RBD_e-Fc]), SEQ ID NO: 153 (LS2382 [NTD_short_a-Fc]), SEQ ID NO: 155 (LS2393 [(RBD-tight)$_2$-Fc]), SEQ ID NO: 157 (LS2394 [(RBD-extended)$_2$-Fc]), SEQ ID NO: 159 (LS2395 [(RBD)$_2$-Fc]), SEQ ID NO: 161 (LS2397-2400 [(CTD_short_d)$_2$-Fc]), SEQ ID NO: 163 (LS2401-2404 [(CTD_short_i)$_2$-Fc]), SEQ ID NO: 165 (LS2421 and LS2422 [(CTD_short_i)$_2$-Fc)-mod. 1], SEQ ID NO: 167 (LS2423 [(CTD_short_i)$_2$-Fc)-mod. 2], SEQ ID NO: 169 (LS2435 [(CTD_short_i)$_2$-Fc)-mod. 3], SEQ ID NO: 217, SEQ ID NO: 219, SEQ ID NO: 221 SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 237, SEQ ID NO: 239, SEQ ID NO: 241, SEQ ID NO: 243, SEQ ID NOs: 255-264 (BA.X-1-monomer-Fc-BA.X-10-monomer-Fc), and SEQ ID NOs: 275-284 (BA.X-1-dimer-Fc-BA.X-10-dimer-Fc). In some embodiments, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 163 (LS2401-2404 [(CTD_short_i)$_2$-Fc]), SEQ ID NO: 165 (LS2421 and LS2422 [(CTD_short_i)$_2$-Fc)-mod. 1], SEQ ID NO: 167 (LS2423 [(CTD_short_i)$_2$-Fc)-mod. 2], and SEQ ID NO: 169 (LS2435 [(CTD_short_i)$_2$-Fc)-mod. 3]. In some embodiments, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to the amino acid sequence of SEQ ID NO: 163 (LS2401-2404 [(CTD_short_i)$_2$-Fc]). In some embodiments, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 161 (LS2397-2400 [(CTD_short_d)$_2$-Fc]), SEQ ID NO: 121 (LS2366 [CTD_short_d-Fc]), SEQ ID NO: 123 (LS2367 [CTD_short_e-Fc]), SEQ ID NO: 129 (LS2370 [CTD_short_h-Fc]), SEQ ID NO: 131 (LS2371 [CTD_short_i-Fc]), and SEQ ID NO: 73 (LS2330 [CTD_short_a-Fc]). In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to the amino acid sequence represented by SEQ ID NO: 163. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to the amino acid sequence represented by SEQ ID NO: 169. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence selected from the group consisting of SEQ ID NOs: 255-264 (BA.X-1-monomer-Fc-BA.X-10-monomer-Fc). In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence selected from the group consisting of SEQ ID NOs: 275-284 (BA.X-1-dimer-Fc-BA.X-10-dimer-Fc). In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 255. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 256. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 257. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 258. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 259. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 260. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 261. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 262. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 263. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 264. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 275. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 276. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 277. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 278. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 279. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 280. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 281. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 282. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 283. In another embodiment, the recombinant polypeptide comprises, consists of, or consists essentially of, an amino acid sequence with at least 90%, preferably at least 91%, 92%, 93%, 94%, 95%, 96%, 97%, 98%, or 99%, sequence identity to an amino acid sequence represented by SEQ ID NO: 284.

In some embodiments, the recombinant polypeptide comprises, consists of, or consists essentially of, an amino acid sequence selected from the group consisting of SEQ ID NOs: 73, 75, 77, 79, 81, 83, 85, 87, 89, 91, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 217, 219, 221, 223, 225, 227, 229, 231, 233, 235, 237, 239, 241, 243, 255-264, and 275-284. In some embodiments, the recombinant polypeptide comprises, consists of, or consists essentially of, an amino acid sequence selected from the group consisting of SEQ ID NO: 163 (LS2401-2404 [(CTD_short_i)$_2$-Fc]), SEQ ID NO: 165 (LS2421 and LS2422 [(CTD_short_i)₂-Fc), SEQ ID NO: 167 (LS2423 [(CTD_short_i)₂-Fc]), and SEQ ID NO: 169 (LS2435 [(CTD_short_i)₂-Fc]). In some embodiments, the recombinant polypeptide comprises, consists of, or consists essentially of, the amino acid sequence of SEQ ID NO: 163 (LS2401-2404 [(CTD_short_i)₂-Fc]). In some embodiments, the recombinant polypeptide comprises, consists of, or consists essentially of, an amino acid sequence selected from the group consisting of SEQ ID NO: 161 (LS2397-2400 [(CTD_short_d)₂-Fc]), SEQ ID NO: 121 (LS2366 [CTD_short_d-Fc]), SEQ ID NO: 123 (LS2367 [CTD_short_e-Fc]), SEQ ID NO: 129 (LS2370 [CTD_short_h-Fc]), SEQ ID NO: 131 (LS2371 [CTD_short_i-Fc]), and SEQ ID NO: 73 (LS2330 [CTD_short_a-Fc]). In another embodiment, the recombinant polypeptide comprises, consists of, or consists essentially of, the amino acid sequence represented by SEQ ID NO: 163. In another embodiment, the recombinant polypeptide comprises, consists of, or consists essentially of, the amino acid sequence represented by SEQ ID NO: 169. In some embodiments, the recombinant polypeptide comprises, consists of, or consists essentially of, an amino acid sequence selected from the group consisting of SEQ ID NOs: 255-264 and SEQ ID NOs: 275-284. In further embodiments, the recombinant polypeptide comprises, consists of, or consists essentially of, an amino acid sequence selected from the group consisting of SEQ ID NOs: 255-264. In another embodiment, the recombinant polypeptide comprises, consists of, or consists essentially of, an amino acid sequence represented by SEQ ID NO: 255. In another embodiment, the recombinant polypeptide comprises, consists of, or consists essentially of, an amino acid sequence represented by SEQ ID NO: 256. In another embodiment, the recombinant polypeptide comprises, consists of, or consists essentially of, an amino acid sequence represented by SEQ ID NO: 257. In another embodiment, the recombinant polypeptide comprises, consists of, or consists essentially of, an amino acid sequence represented by SEQ ID NO: 258. In another embodiment, the recombinant polypeptide comprises, consists of, or consists essentially of, an amino acid sequence represented by SEQ ID NO: 259. In another embodiment, the recombinant polypeptide comprises, consists of, or consists essentially of, an amino acid sequence represented by SEQ ID NO: 260. In another embodiment, the recombinant polypeptide comprises, consists of, or consists essentially of, an amino acid sequence represented by SEQ ID NO: 261. In another embodiment, the recombinant polypeptide comprises, consists of, or consists essentially of, an amino acid sequence represented by SEQ ID NO: 262. In another embodiment, the recombinant polypeptide comprises, consists of, or consists essentially of, an amino acid sequence represented by SEQ ID NO: 263. In another embodiment, the recombinant polypeptide comprises, consists of, or consists essentially of, an amino acid sequence represented by SEQ ID NO: 264. In another embodiment, the recombinant polypeptide comprises, consists of, or consists essentially of, an amino acid sequence represented by SEQ ID NO: 275. In another embodiment, the recombinant polypeptide comprises, consists of, or consists essentially of, an amino acid sequence represented by SEQ ID NO: 276. In another embodiment, the recombinant polypeptide comprises, consists of, or consists essentially of, an amino acid sequence represented by SEQ ID NO: 277. In another embodiment, the recombinant polypeptide comprises, consists of, or consists essentially of, an amino acid sequence represented by SEQ ID NO: 278. In another embodiment, the recombinant polypeptide comprises, consists of, or consists essentially of, an amino acid sequence represented by SEQ ID NO: 279. In another embodiment, the recombinant polypeptide comprises, consists of, or consists essentially of, an amino acid sequence represented by SEQ ID NO: 280. In another embodiment, the recombinant polypeptide comprises, consists of, or consists essentially of, an amino acid sequence represented by SEQ ID NO: 281. In another embodiment, the recombinant polypeptide comprises, consists of, or consists essentially of, an amino acid sequence represented by SEQ ID NO: 282. In another embodiment, the recombinant polypeptide comprises, consists of, or consists essentially of, an amino acid sequence represented by SEQ ID NO: 283. In another embodiment, the recombinant polypeptide comprises, consists of, or consists essentially of, an amino acid sequence represented by SEQ ID NO: 284.

In some embodiments, the recombinant polypeptide is encoded by a recombinant polynucleotide. In certain embodiments, the polynucleotide comprises, consists of, or consists essentially of a nucleic acid sequence with at least 90%, preferably at least 91%, 92%, 93%, 94%, 95%, 96%, 97%, 98%, or 99%, sequence identity to a nucleic acid sequence selected from the group consisting of SEQ ID NO: 74 (LS2330 [CTD_short_a-Fc]), SEQ ID NO: 76 (LS3472, LS3473, LS3474 [CTD_long_a-Fc]), SEQ ID NO: 78 (LS3477 [CTD_short_a-TEV-Fc]), SEQ ID NO: 80 (LS3485 [CTD_long_a TEV-Fc]), SEQ ID NO: 82 (LS3489 [CTD_short_a_Rv3c-Fc]), SEQ ID NO: 84 (LS3497 [CTD_long_a-Rv3c-Fc], SEQ ID NO: 86 (LS2316, LS2317, LS2318, LS2319 [CTD_long_a-His8]), SEQ ID NO: 88 (LS3479 [NTD_short_a-TEV-Fc]), SEQ ID NO: 90 (LS3475 [NTD_long_a-TEV-Fc]), SEQ ID NO: 92 (LS3491 [NTD_short_a-Rv3c-Fc]), SEQ ID NO: 94 (LS3487 [NTD_long_a-Rv3C-Fc]), SEQ ID NO: 96 (LS2326 [NTD_long_a-Fc]), SEQ ID NO: 98 (LS2354 [CTD_long_a D614G-Fc]), SEQ ID NO: 100 (LS2355 [CTD_long_a-Dimer-Fc]), SEQ ID NO:102 (LS2356 [CTD_long_b-Fc]), SEQ ID NO: 104 (LS2357 [CTD_long_c-Fc]), SEQ ID NO: 106 (LS2358 [CTD_long_d-Fc]), SEQ ID NO: 108 (LS2359 [CTD_long_e-Fc]), SEQ ID NO: 110 (LS2360 [CTD_long_f-Fc]), SEQ ID NO: 112 (LS2361 [CTD_long_g-Fc]), SEQ ID NO: 114 (LS2362 [CTD_long_h-Fc]), SEQ ID NO: 116 (LS2363 [CTD_long_i-Fc]), SEQ ID NO: 118 (LS2364 [CTD_short_b-Fc]), SEQ ID NO: 120 (LS2365 [CTD_short_c-Fc]), SEQ ID NO: 122 (LS2366 [CTD_short_d-Fc]), SEQ ID NO: 124 (LS2367 [CTD_short_e-Fc]), SEQ ID NO: 126 (LS2368 [CTD_short_f-Fc]), SEQ ID NO: 128 (LS2369 [CTD_short_g-Fc]), SEQ ID NO: 130 (LS2370 [CTD_short_h-Fc]), SEQ ID NO: 132 (LS2371 [CTD_short_i-Fc]), SEQ ID NO: 134 (LS2372 [CTD_vs_a-Fc]), SEQ ID NO: 136 (LS2373 [CTD_vs_b-Fc]), SEQ ID NO: 138 (LS2374 [CTD_vs_c-Fc]), SEQ ID NO: 140 (LS2375 [CTD_vs_d-Fc]), SEQ ID NO: 142 (LS2376 [CTD_vs_e-Fc]), SEQ ID NO: 144 (LS2377 [RBD_a-Fc]), SEQ ID NO: 146 (LS2378 [RBD_b-Fc]), SEQ ID NO: 148 (LS2379 [RBD_c-Fc]), SEQ ID NO: 150 (LS2380 [RBD_d-Fc]), SEQ ID NO: 152 (LS2381 [RBD_e-Fc]), SEQ ID NO: 154 (LS2382 [NTD_short_a-Fc]), SEQ ID NO: 156 (LS2393 [(RBD-tight)₂-Fc]), SEQ ID NO: 158 (LS2394 [(RBD-extended)₂-Fc]), SEQ ID NO: 160 (LS2395 [(RBD)₂-Fc]), SEQ ID NO: 162 (LS2397-2400 [(CTD_short_d)₂-Fc]), SEQ ID NO: 164 (LS2401-2404 [(CTD_short_i)₂-Fc]), SEQ ID NO: 166 (LS2421 and LS2422 [(CTD_short_i)₂-Fc), SEQ ID NO: 168 (LS2423 [(CTD_short_i)₂-Fc), SEQ ID NO: 170 (LS2435 [(CTD_short_i)₂-Fc), SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NOs: 295-304, and SEQ ID NOs: 315-324.

In some embodiments, the polynucleotide comprises, consists of, or consists essentially of a nucleic acid sequence with at least 90%, preferably at least 91%, 92%, 93%, 94%, 95%, 96%, 97%, 98%, or 99%, sequence identity to a nucleic acid sequence selected from the group consisting of SEQ ID NO: 164 (LS2401-2404 [(CTD_short_i)$_2$-Fc]), SEQ ID NO: 166 (LS2421 and LS2422 [(CTD_short_i)$_2$-Fc)-mod.1], SEQ ID NO: 168 (LS2423 [(CTD_short_i)$_2$-Fc)-mod. 2]), and SEQ ID NO: 170 (LS2435 [(CTD_short_i)$_2$-Fc-mod. 3). In some embodiments, the polynucleotide comprises, consists of, or consists essentially of, an nucleic acid sequence with at least 90%, preferably at least 91%, 92%, 93%, 94%, 95%, 96%, 97%, 98%, or 99%, sequence identity to the nucleic acid sequence of SEQ ID NO: 164 (LS2401-2404 [(CTD_short_i)$_2$-Fc]). In some embodiments, the polynucleotide comprises, consists of, or consists essentially of, an nucleic acid sequence with at least 90%, preferably at least 91%, 92%, 93%, 94%, 95%, 96%, 97%, 98%, or 99%, sequence identity to an nucleic acid sequence selected from the group consisting of SEQ ID NO: 162 (LS2397-2400 [(CTD_short_d)$_2$-Fc]), SEQ ID NO: 122 (LS2366 [CTD_short_d-Fc]), SEQ ID NO: 124 (LS2367 [CTD_short_e-Fc]), SEQ ID NO: 130 (LS2370 [CTD_short_h-Fc]), SEQ ID NO: 132 (LS2371 [CTD_short_i-Fc]), and SEQ ID NO: 74 (LS2330 [CTD_short_a-Fc]). In an embodiment, the polynucleotide comprises, consists of, or consists essentially of a nucleic acid sequence with at least 90%, preferably at least 91%, 92%, 93%, 94%, 95%, 96%, 97%, 98%, or 99%, sequence identity to the nucleic acid sequence represented by SEQ ID NO: 164. In an embodiment, the polynucleotide comprises, consists of, or consists essentially of a nucleic acid sequence with at least 90%, preferably at least 95%, 96%, 97%, 98%, or 99%, sequence identity to the nucleic acid sequence represented by SEQ ID NO: 170. In certain embodiments, the polynucleotide comprises, consists of, or consists essentially of a nucleic acid sequence with at least 90%, preferably at least 91%, 92%, 93%, 94%, 95%, 96%, 97%, 98%, or 99%, sequence identity to the nucleic acid sequence selected from the group consisting of SEQ ID NOs: 295-304 and SEQ ID NOs: 315-324. In certain embodiments, the polynucleotide comprises, consists of, or consists essentially of a nucleic acid sequence with at least 90%, preferably at least 91%, 92%, 93%, 94%, 95%, 96%, 97%, 98%, or 99%, sequence identity to the nucleic acid sequence selected from the group consisting of SEQ ID NOs: 295-304.

In some embodiments, the polynucleotide comprises, consists of, or consists essentially of a nucleic acid sequence selected from the group consisting of SEQ ID NO: 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 218, 220, 222, 224, 226, 228, 230, 232, 234, 236, 238, 240, 242, 244, 295-304, and 315-324. In some embodiments, the polynucleotide comprises, consists of, or consists essentially of a nucleic acid sequence selected from the group consisting of SEQ ID NO: 164 (LS2401-2404 [(CTD_short_i)$_2$-Fc]), SEQ ID NO: 166 (LS2421 and LS2422 [(CTD_short_i)$_2$-Fc)-mod. 1], SEQ ID NO: 168 (LS2423 [(CTD_short_i)$_2$-Fc)-mod.2], and SEQ ID NO: 170 (LS2435 [(CTD_short_i)$_2$-Fc)-mod. 3]. In some embodiments, the polynucleotide comprises, consists of, or consists essentially of, the nucleic acid sequence of SEQ ID NO: 164 (LS2401-2404 [(CTD_short_i)$_2$-Fc]). In some embodiments, polynucleotide comprises, consists of, or consists essentially of, an nucleic acid sequence selected from the group consisting of SEQ ID NO: 162 (LS2397-2400 [(CTD_short_d)$_2$-Fc]), SEQ ID NO: 122 (LS2366 [CTD_short_d-Fc]), SEQ ID NO: 124 (LS2367 [CTD_short_e-Fc]), SEQ ID NO: 130 (LS2370 [CTD_short_h-Fc]), SEQ ID NO: 132 (LS2371 [CTD_short_i-Fc]), and SEQ ID NO: 74 (LS2330 [CTD_short_a-Fc]). In an embodiment, the polynucleotide comprises, consists of, or consists essentially of a nucleic acid sequence represented by SEQ ID NO: 164. In an embodiment, the polynucleotide comprises, consists of, or consists essentially of a nucleic acid sequence represented by SEQ ID NO: 170. In certain embodiments, the polynucleotide comprises, consists of, or consists essentially of a nucleic acid sequence selected from the group consisting of SEQ ID NOs: 295-304 and SEQ ID NOs: 315-324. In certain embodiments, the polynucleotide comprises, consists of, or consists essentially of a nucleic acid sequence selected from the group consisting of SEQ ID NOs: 295-304.

Nucleic acid or amino acid sequence "identity," as referenced herein, can be determined by comparing a nucleic acid or amino acid sequence of interest to a reference nucleic acid or amino acid sequence. The percent identity is the number of nucleotides or amino acid residues that are the same (i.e., that are identical) as between the optimally aligned sequence of interest and the reference sequence divided by the length of the longest sequence (i.e., the length of either the sequence of interest or the reference sequence, whichever is longer). Alignment of sequences and calculation of percent identity can be performed using available software programs. Examples of such programs include CLUSTAL-W, T-Coffee, and ALIGN (for alignment of nucleic acid and amino acid sequences), BLAST programs (e.g., BLAST 2.1, BL2SEQ, BLASTp, BLASTn, and the like) and FASTA programs (e.g., FASTA3x, FASTM, and SSEARCH) (for sequence alignment and sequence similarity searches). Sequence alignment algorithms also are disclosed in, for example, Altschul et al., *J. Molecular Biol.,* 215(3): 403-410 (1990), Beigert et al., *Proc. Natl. Acad. Sci. USA,* 106(10): 3770-3775 (2009), Durbin et al., eds., *Biological Sequence Analysis: Probalistic Models of Proteins and Nucleic Acids,* Cambridge University Press, Cambridge, UK (2009), Soding, *Bioinformatics,* 21(7): 951-960 (2005), Altschul et al., *Nucleic Acids Res.,* 25(17): 3389-3402 (1997), and Gusfield, Algorithms on Strings, Trees and Sequences, Cambridge University Press, Cambridge UK (1997)). Percent (%) identity of sequences can be also calculated, for example, as $100 \times [(\text{identical positions})/\min(TG_A, TG_B)]$, where $TG_A$ and $TG_B$ are the sum of the number of residues and internal gap positions in peptide sequences A and B in the alignment that minimizes $TG_A$ and $TG_B$. See, e.g., Russell et al., *J. Mol. Biol.,* 244: 332-350 (1994).

In some embodiments, the nucleotide sequence of the polynucleotide is codon optimized and/or codon pair optimized.

Another embodiment is a recombinant vector that comprises, consists of, or consists essentially of, a polynucleotide that encodes the recombinant polypeptide described herein. The recombinant vector can be any suitable vector. Examples of suitable recombinant vectors include but are not limited to a pcDNA3.1, a pSV, a pCMV, a pBApo-CMV, or a pBApo-EF1alpha expression vector.

Yet another embodiment is an isolated cell that includes the recombinant polypeptide described herein or a recombinant polynucleotide that contains a nucleic acid sequence that encodes the recombinant polypeptide.

Another embodiment is a pharmaceutical composition that contains the recombinant polypeptide described herein and at least one pharmaceutically acceptable carrier. The at least one pharmaceutically acceptable carrier can be any suitable carrier. Examples of suitable carriers include water and any suitable buffer. Suitable buffers include HEPES-buffered saline and phosphate-buffered saline. In certain embodiments, the pharmaceutical composition further contains at least one adjuvant. The at least one adjuvant can be any suitable adjuvant. Examples of suitable adjuvants include alum adjuvants, emulsion adjuvants, and pattern recognition receptor agonist adjuvants. Further examples include AS03, MF59, Squalene Emulsion, Alum, aluminum hydroxide gels, calcium phosphate hydroxide, paraffin oil, cytokines (IL-1, IL-2, IL-12), killed bacterial products such as *Bordetella* and *Mycobacterium* bacteria, bacterial toxoids, squalene and DL-a-tocopherol emulsions, squalene-oil-in-water emulsion, aluminum phosphate gels, saponins, cyclic dinucleotides, and TLR agonists, preferably TLR1, TLR2, TLR4, TLR5, TLR7, TLR8, TLR9 etc., and combinations thereof. In certain embodiments, the adjuvant is AS03. In certain other embodiments, the adjuvant is Alum. In yet further embodiments, the pharmaceutical composition does not contain an adjuvant.

The pharmaceutical composition can contain any therapeutically effective amount of the recombinant polypeptide described herein. A therapeutically effective amount is an amount sufficient to induce an immune response against the target virus or viruses, for instance, SARS-CoV-2, SARS-CoV, and/or MERS-CoV, preferably SARS-CoV-2. Typically, a dosage is therapeutically effective if it prevents, inhibits, reduces, eliminates, protects against, and/or delays the onset of an infection or an infectious clinical condition caused by a beta coronavirus in a subject. Infectious clinical conditions include, for example, fever or chills, cough, shortness of breath or difficult breathing, fatigue, muscle or body aches, headache, loss of taste or smell, sore throat, congestion, runny nose, nausea, vomiting, and diarrhea. In some embodiments, a single dose of the pharmaceutical composition contains 10 nanograms to 1 milligram, 0.1-250 micrograms, 10-100 micrograms, or 12.5-50 micrograms of the recombinant polypeptide. In some embodiments, a single dose of the pharmaceutical composition contains 0.01-1, 0.1-1, 0.5-5, 1-20, or 5-15, 1-50, or 10-50 micrograms of the recombinant polypeptide. In some embodiments, wherein the pharmaceutical composition does not contain an adjuvant, a single dose of the pharmaceutical composition could contain. 01-1, 0.1-1, 0.5-5, 1-20, or 5-15, 1-50, or 10-50 micrograms of the recombinant polypeptide. However, a single dose of the pharmaceutical composition could also contain increased amounts of the recombinant polypeptide, such as 100-1000, 100-250, or 250-500 micrograms of recombinant polypeptide.

A further embodiment is a method for preventing, inhibiting, reducing, eliminating, protecting against, or delaying the onset of an infection or an infectious clinical condition caused by a beta coronavirus in a subject comprising administering to the subject the recombinant polypeptide described herein, the polypeptide encoded by the recombinant polynucleotide described herein, or a dose of the pharmaceutical composition described herein. Examples of beta coronaviruses include SARS-CoV, MERS-CoV, and SARS-CoV-2.

Another embodiment is a method for inducing an immune response against a beta coronavirus in a subject comprising administering to the subject the recombinant polypeptide described herein, the polypeptide encoded by the recombinant polynucleotide described herein, or a dose of the pharmaceutical composition described herein. Examples of beta coronaviruses include SARS-CoV, MERS-CoV, and SARS-CoV-2.

In the methods described herein, administration can be achieved by any suitable administration method. Suitable administration methods include oral, parenteral, subcutaneous, intravenous, intramuscular, intrapulmonary, intranasal, intraarterial, intrathecal, and intraperitoneal administration.

In the methods described herein, the subject can be any suitable animal that is capable of being infected by a beta coronavirus, such as SARS-CoV, MERS-CoV, and SARS-CoV-2. The subject can be a human, non-human primate, horse, pig, cattle, cat, dog, sheep, mink, rodent, hamster, or bat, preferably human.

Examples of Non-Limiting Aspects of the Disclosure

Aspects, including embodiments, of the invention described herein may be beneficial alone or in combination, with one or more other aspects or embodiments. Without limiting the foregoing description, certain non-limiting aspects of the disclosure numbered (1)-(36) are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

(1) A recombinant polypeptide comprising at least one immunogenic fragment of Severe Acute Respiratory Syndrome Coronavirus 2 (SARS-CoV-2) spike glycoprotein and optionally an antibody Fc region.

(2) The recombinant polypeptide of aspect 1, wherein the at least one fragment of the SARS-CoV-2 spike glycoprotein comprises the N-terminal domain of the S1 subunit, the C-terminal domain of the S1 subunit, or both.

(3) The recombinant polypeptide of aspect 1 or 2, wherein the at least one fragment of the SARS-CoV-2 spike glycoprotein comprises an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 1 (CTD_long_a), SEQ ID NO: 3 (CTD_long_a D614G), SEQ ID NO: 5 (CTD_long_a-Dimer), SEQ ID NO: 7 (CTD_long_b), SEQ ID NO: 9 (CTD_long_c), SEQ ID NO: 11 (CTD_long_d), SEQ ID NO: 13 (CTD_long_e), SEQ ID NO: 15 (CTD_long_f), SEQ ID NO: 17 (CTD_long_g), SEQ ID NO: 19 (CTD_long_h), SEQ ID NO: 21 (CTD_long_i), SEQ ID NO: 23 (CTD_short_a), SEQ ID NO: 25 (CTD_short_b), SEQ ID NO: 27 (CTD_short_c), SEQ ID NO: 29 (CTD_short_d), SEQ ID NO: 31 (CTD_short_e), SEQ ID NO: 33 (CTD_short_f), SEQ ID NO: 35 (CTD_short_g), SEQ ID NO: 37 (CTD_short_h), SEQ ID NO: 39 (CTD_short_i), SEQ ID NO: 41 (CTD_vs_a), SEQ ID NO: 43 (CTD_vs_b), SEQ ID NO: 45 (CTD_vs_c), SEQ ID NO: 47 (CTD_vs_d), SEQ ID NO: 49 (CTD_vs_e), SEQ ID NO: 51 (RBD_a), SEQ ID NO: 53 (RBD_b), SEQ ID NO: 55 (RBD_c), SEQ ID NO: 57 (RBD_d), SEQ ID NO: 59 (RBD_e), SEQ ID NO: 61 (NTD_long_a), SEQ ID NO: 63 (NTD_short_a), SEQ ID NO: 171 (RBD-tight), SEQ ID NO: 173 ((RBD-tight)$_2$), SEQ ID NO: 175 (RBD-extended), SEQ ID NO: 177 ((RBD-extended)$_2$), SEQ ID NO: 179 (RBD), SEQ ID NO:

181 ((RBD)$_2$), SEQ ID NO: 183 ((CTD_short_d)$_2$), SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), SEQ ID NO: 191 ((CTD_short_i)$_2$—mod. 3), SEQ ID NOs: 245-254 (BA.X-1-BA.X-10), and SEQ ID NOs: 265-274 (BA.X-1-dimer-BA.X-10-dimer).

(4) The recombinant polypeptide of any one of aspects 1-3, wherein the polypeptide comprises an amino acid sequence selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 171, 173, 175, 177, 179, 181, 183, 185, 187, 189, 191, 199, 201, 203, 205, 207, 209, 211, 213, 215, 245-254, and 265-274.

(5) The recombinant polypeptide of any of one aspects 1-4, wherein the polypeptide comprises at least two immunogenic fragments.

(6) The recombinant polypeptide of aspect 5, wherein each of the at least two immunogenic fragments comprises an amino acid sequence with at least 90%, preferably at least 91%, 92%, 93%, 94%, 95%, 96%, 97%, 98%, or 99%, sequence identity to an amino acid sequence selected from the group consisting of SEQ ID NO: 1 (CTD_long_a), SEQ ID NO: 3 (CTD_long_a D614G), SEQ ID NO: 5 (CTD_long_a-Dimer), SEQ ID NO: 7 (CTD_long_b), SEQ ID NO: 9 (CTD_long_c), SEQ ID NO: 11 (CTD_long_d), SEQ ID NO: 13 (CTD_long_e), SEQ ID NO: 15 (CTD_long_f), SEQ ID NO: 17 (CTD_long_g), SEQ ID NO: 19 (CTD_long_h), SEQ ID NO: 21 (CTD_long_i), SEQ ID NO: 23 (CTD_short_a), SEQ ID NO: 25 (CTD_short_b), SEQ ID NO: 27 (CTD_short_c), SEQ ID NO: 29 (CTD_short_d), SEQ ID NO: 31 (CTD_short_e), SEQ ID NO: 33 (CTD_short_f), SEQ ID NO: 35 (CTD_short_g), SEQ ID NO: 37 (CTD_short_h), SEQ ID NO: 39 (CTD_short_i), SEQ ID NO: 41 (CTD_vs_a), SEQ ID NO: 43 (CTD_vs_b), SEQ ID NO: 45 (CTD_vs_c), SEQ ID NO: 47 (CTD_vs_d), SEQ ID NO: 49 (CTD_vs_e), SEQ ID NO: 51 (RBD_a), SEQ ID NO: 53 (RBD_b), SEQ ID NO: 55 (RBD_c), SEQ ID NO: 57 (RBD_d), SEQ ID NO: 59 (RBD_e), SEQ ID NO: 61 (NTD_long_a), SEQ ID NO: 63 (NTD_short_a), SEQ ID NO: 171 (RBD-tight), SEQ ID NO: 173 ((RBD-tight)$_2$), SEQ ID NO: 175 (RBD-extended), SEQ ID NO: 177 ((RBD-extended)$_2$), SEQ ID NO: 179 (RBD), SEQ ID NO: 181 ((RBD)$_2$), SEQ ID NO: 183 ((CTD_short_d)$_2$), SEQ ID NO: 185 ((CTD_short_i)$_2$), SEQ ID NO: 187 ((CTD_short_i)$_2$—mod. 1), SEQ ID NO: 189 ((CTD_short_i)$_2$—mod. 2), SEQ ID NO: 191 ((CTD_short_i)$_2$—mod. 3), SEQ ID NO: 199 (SARS-2003, SARS_short_h), SEQ ID NO: 201 (SARS-2003, SARS_short_i), SEQ ID NO: 203 (MERS_Lytic_a), SEQ ID NO: 205 (MERS_Lytic_b), SEQ ID NO: 207 (MERS_Lytic_c), SEQ ID NO: 209 (MERS_Lytic_d), SEQ ID NO: 211 (MERS_Lytic_e), SEQ ID NO: 213 (MERS_Lytic_f), SEQ ID NO: 215 (MERS_Lytic_g), SEQ ID NOs: 245-254 (BA.X-1-BA.X-10), and SEQ ID NOs: 265-274 (BA.X-1-dimer-BA.X-10-dimer).

(7) The recombinant polypeptide of aspect 5, wherein each of the at least two immunogenic fragments comprises an amino acid sequence selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 173, 175, 177, 179, 181, 183, 185, 187, 189, 191, 199, 201, 203, 205, 207, 209, 211, 213, 215, 245-254, and 265-274.

(8) The recombinant polypeptide of any one of aspects 5-7, wherein each immunogenic fragment of the at least two immunogenic fragments comprises the same amino acid sequence.

(9) The recombinant polypeptide of any one of aspects 5-8, wherein each immunogenic fragment of the at least two immunogenic fragments comprises a different amino acid sequence from the other immunogenic fragments.

(10) The recombinant polypeptide of any one of aspects 1-9, wherein the polypeptide comprises two, three, four, or five immunogenic fragments.

(11) The recombinant polypeptide of any one of aspects 5-10, wherein the at least two immunogenic fragments are connected to each other via a linker.

(12) The recombinant polypeptide of aspect 11, wherein the linker is a polypeptide comprising an amino acid sequence of 1-35 residues, wherein each residue is independently serine or glycine.

(13) The recombinant polypeptide of any one of aspects 1-12, wherein the at least one immunogenic fragment of the SARS-CoV-2 spike glycoprotein is connected to the antibody Fc region via a linker.

(14) The recombinant polypeptide of aspect 13, wherein the linker comprises an amino acid sequence selected from the group consisting of SEQ ID NO: 65 (Fc1), SEQ ID NO: 67 (Fc1-TEV), SEQ ID NO: 69 (Fc1-Rv3C), SEQ ID NO: 193 (Short), SEQ ID NO: 195 (Medium), and SEQ ID NO: 197 (Long).

(15) The recombinant polypeptide of any one of aspects 1-14, wherein the antibody Fc region is from a human IgG1 antibody or derived therefrom.

(16) The recombinant polypeptide of aspect 15, wherein the antibody Fc region comprises the amino acid sequence of SEQ ID NO: 71.

(17) The recombinant polypeptide of any one of aspects 1-16, wherein the polypeptide comprises an amino acid sequence with at least 90%, preferably at least 95%, 96%, 97%, 98%, or 99%, sequence identity to an amino acid sequence selected from the group consisting of SEQ ID NO: 73 (LS2330 [CTD_short_a-Fc]), SEQ ID NO: 75 (LS3472, LS3473, LS3474 [CTD_long_a-Fc]), SEQ ID NO: 77 (LS3477 [CTD_short_a-TEV-Fc]), SEQ ID NO: 79 (LS3485 [CTD_long_a TEV-Fc]), SEQ ID NO: 81 (LS3489 [CTD_short_a_Rv3c-Fc]), SEQ ID NO: 83 (LS3497 [CTD_long_a-Rv3c-Fc], SEQ ID NO: 85 (LS2316, LS2317, LS2318, LS2319 [CTD_long_a-Hiss]), SEQ ID NO: 87 (LS3479 [NTD_short_a-TEV-Fc]), SEQ ID NO: 89 (LS3475 [NTD_long_a-TEV-Fc]), SEQ ID NO: 91 (LS3491 [NTD_short_a-Rv3c-Fc]), SEQ ID NO: 93 (LS3487 [NTD_long_a-Rv3C-Fc]), SEQ ID NO: 95 (LS2326 [NTD_long_a-Fc]), SEQ ID NO: 97 (LS2354 [CTD_long_a D614G-Fc]), SEQ ID NO: 99 (LS2355 [CTD_long_a-Dimer-Fc]), SEQ ID NO:101 (LS2356 [CTD_long_b-Fc]), SEQ ID NO: 103 (LS2357 [CTD_long_c-Fc]), SEQ ID NO: 105 (LS2358 [CTD_long_d-Fc]), SEQ ID NO: 107 (LS2359 [CTD_long_e-Fc]), SEQ ID NO: 109 (LS2360 [CTD_long_f-Fc]), SEQ ID NO: 111 (LS2361 [CTD_long_g-Fc]), SEQ ID NO: 113 (LS2362 [CTD_long_h-Fc]), SEQ ID NO: 115 (LS2363 [CTD_long_i-Fc]), SEQ ID NO: 117 (LS2364 [CTD_short_b-Fc]), SEQ ID NO: 119 (LS2365 [CTD_short_c-Fc]), SEQ ID NO: 121 (LS2366 [CTD_short_d-Fc]), SEQ ID NO: 123 (LS2367 [CTD_short_e-Fc]), SEQ ID NO: 125 (LS2368 [CTD_short_f-Fc]), SEQ ID NO: 127 (LS2369 [CTD_short_g-Fc]), SEQ ID NO: 129 (LS2370 [CTD_short_h-Fc]), SEQ ID NO: 131 (LS2371

[CTD_short_i-Fc]), SEQ ID NO: 133 (LS2372 [CTD_vs_a-Fc]), SEQ ID NO: 135 (LS2373 [CTD_vs_b-Fc]), SEQ ID NO: 137 (LS2374 [CTD_vs_c-Fc]), SEQ ID NO: 139 (LS2375 [CTD_vs_d-Fc]), SEQ ID NO: 141 (LS2376 [CTD_vs_e-Fc]), SEQ ID NO: 143 (LS2377 [RBD_a-Fc]), SEQ ID NO: 145 (LS2378 [RBD_b-Fc]), SEQ ID NO: 147 (LS2379 [RBD_c-Fc]), SEQ ID NO: 149 (LS2380 [RBD_d-Fc]), SEQ ID NO: 151 (LS2381 [RBD_e-Fc]), SEQ ID NO: 153 (LS2382 [NTD_short_a-Fc]), SEQ ID NO: 155 (LS2393 [(RBD-tight)$_2$-Fc]), SEQ ID NO: 157 (LS2394 [(RBD-extended)$_2$-Fe]), SEQ ID NO: 159 (LS2395 [(RBD)$_2$-Fc]), SEQ ID NO: 161 (LS2397-2400 [(CTD_short_d)$_2$-Fc]), SEQ ID NO: 163 (LS2401-2404 [(CTD_short_i)$_2$-Fc]), SEQ ID NO: 165 (LS2421 and LS2422 [(CTD_short_i)$_2$-Fc)-mod. 1], SEQ ID NO: 167 (LS2423 [(CTD_short_i)$_2$-Fc)-mod. 2], SEQ ID NO: 169 (LS2435 [(CTD_short_i)$_2$-Fc)-mod. 3], SEQ ID NOs: 255-264, and SEQ ID NOs: 275-284.

(18) The recombinant polypeptide of aspect 17, wherein the polypeptide comprises an amino acid sequence selected from the group consisting of SEQ ID NOS: 73, 75, 77, 79, 81, 83, 85, 87, 89, 91, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 217, 219, 221, 223, 225, 227, 229, 231, 233, 235, 237, 239, 241, 243, 255-264, and 275-284.

(19) A recombinant polynucleotide encoding the recombinant polypeptide of any one of aspects 1-18.

(20) The recombinant polynucleotide of aspect 19, wherein the polynucleotide comprises a nucleic acid sequence with at least 90%, preferably at least 95%, 96%, 97%, 98%, or 99%, sequence identity to a nucleic acid sequence selected from the group consisting of SEQ ID NO: 74 (LS2330 [CTD_short_a-Fc]), SEQ ID NO: 76 (LS3472, LS3473, LS3474 [CTD_long_a-Fc]), SEQ ID NO: 78 (LS3477 [CTD_short_a-TEV-Fc]), SEQ ID NO: 80 (LS3485 [CTD_long_a TEV-Fc]), SEQ ID NO: 82 (LS3489 [CTD_short_a_Rv3c-Fc]), SEQ ID NO: 84 (LS3497 [CTD_long_a-Rv3c-Fc], SEQ ID NO: 86 (LS2316, LS2317, LS2318, LS2319 [CTD_long_a-Hiss]), SEQ ID NO: 88 (LS3479 [NTD_short_a-TEV-Fc]), SEQ ID NO: 90 (LS3475 [NTD_long_a-TEV-Fc]), SEQ ID NO: 92 (LS3491 [NTD_short_a-Rv3c-Fc]), SEQ ID NO: 94 (LS3487 [NTD_long_a-Rv3C-Fc]), SEQ ID NO: 96 (LS2326 [NTD_long_a-Fc]), SEQ ID NO: 98 (LS2354 [CTD_long_a D614G-Fc]), SEQ ID NO: 100 (LS2355 [CTD_long_a-Dimer-Fc]), SEQ ID NO:102 (LS2356 [CTD_long_b-Fc]), SEQ ID NO: 104 (LS2357 [CTD_long_c-Fc]), SEQ ID NO: 106 (LS2358 [CTD_long_d-Fc]), SEQ ID NO: 108 (LS2359 [CTD_long_e-Fc]), SEQ ID NO: 110 (LS2360 [CTD_long_f-Fc]), SEQ ID NO: 112 (LS2361 [CTD_long_g-Fc]), SEQ ID NO: 114 (LS2362 [CTD_long_h-Fc]), SEQ ID NO: 116 (LS2363 [CTD_long_i-Fc]), SEQ ID NO: 118 (LS2364 [CTD_short_b-Fc]), SEQ ID NO: 120 (LS2365 [CTD_short_c-Fc]), SEQ ID NO: 122 (LS2366 [CTD_short_d-Fc]), SEQ ID NO: 124 (LS2367 [CTD_short_e-Fc]), SEQ ID NO: 126 (LS2368 [CTD_short_f-Fc]), SEQ ID NO: 128 (LS2369 [CTD_short_g-Fc]), SEQ ID NO: 130 (LS2370 [CTD_short_h-Fc]), SEQ ID NO: 132 (LS2371 [CTD_short_i-Fc]), SEQ ID NO: 134 (LS2372 [CTD_vs_a-Fc]), SEQ ID NO: 136 (LS2373 [CTD_vs_b-Fc]), SEQ ID NO: 138 (LS2374 [CTD_vs_c-Fc]), SEQ ID NO: 140 (LS2375 [CTD_vs_d-Fc]), SEQ ID NO: 142 (LS2376 [CTD_vs_e-Fc]), SEQ ID NO: 144 (LS2377 [RBD_a-Fc]), SEQ ID NO: 146 (LS2378 [RBD_b-Fc]), SEQ ID NO: 148 (LS2379 [RBD_c-Fc]), SEQ ID NO: 150 (LS2380 [RBD_d-Fc]), SEQ ID NO: 152 (LS2381 [RBD_e-Fc]), SEQ ID NO: 154 (LS2382 [NTD_short_a-Fc]), SEQ ID NO: 156 (LS2393 [(RBD-tight)$_2$-Fc]), SEQ ID NO: 158 (LS2394 [(RBD-extended)$_2$-Fc]), SEQ ID NO: 160 (LS2395 [(RBD)$_2$-Fc]), SEQ ID NO: 162 (LS2397-2400 [(CTD_short_d)$_2$-Fc]), SEQ ID NO: 164 (LS2401-2404 [(CTD_short_i)$_2$-Fc]), SEQ ID NO: 166 (LS2421 and LS2422 [(CTD_short_i)$_2$-Fc)-mod. 1], SEQ ID NO: 168 (LS2423 [(CTD_short_i)$_2$-Fc)-mod. 1], and SEQ ID NO: 170 (LS2435 [(CTD_short_i)$_2$-Fc)-mod. 3], SEQ ID NOs: 295-304, and SEQ ID NOs: 315-324.

(21) The recombinant polynucleotide of aspect 20, wherein the polynucleotide comprises a nucleic acid sequence selected from the group consisting of SEQ ID NO: 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 218, 220, 222, 224, 226, 228, 230, 232, 234, 236, 238, 240, 242, 244, 295-304, and 315-324.

(22) The recombinant polynucleotide of any one of aspects 19-21, wherein the nucleic acid sequence has been codon optimized.

(23) A pharmaceutical composition comprising the recombinant polypeptide of any one of aspects 1-18 or the polypeptide encoded by the recombinant polynucleotide of any one of aspects 19-22, and a pharmaceutically acceptable carrier.

(24) The pharmaceutical composition of aspect 23, wherein the pharmaceutical composition further comprises at least one adjuvant.

(25) The pharmaceutical composition of aspect 24, wherein the at least one adjuvant is selected from the group consisting of alum adjuvants, emulsion adjuvants, and pattern recognition receptor agonist adjuvants.

(26) The pharmaceutical composition of aspect 25, wherein the at least one adjuvant is MF59, Squalene Emulsion, Alum, aluminum hydroxide gels, calcium phosphate hydroxide, paraffin oil, cytokines (IL-1, IL-2, IL-12), killed bacterial products such as *Bordetella* and *Mycobacterium* bacteria, bacterial toxoids, squalene and DL-a-tocopherol emulsions, aluminum phosphate gels, saponins, cyclic dinucleotides, and TLR agonists, preferably TLR1, TLR2, TLR4, TLR5, TLR7, TLR8, TLR9 etc., and combinations thereof.

(27) The pharmaceutical composition of aspect 24, wherein the at least one adjuvant is a squalene-oil-in-water emulsion adjuvant.

(28) A vector comprising the recombinant polynucleotide of any one of aspects 19-22.

(29) An isolated cell comprising the recombinant polypeptide of any one of aspects 1-18, or the polypeptide encoded by the recombinant polynucleotide of any one of aspects 19-22.

(30) A method for preventing, inhibiting, reducing, eliminating, protecting, or delaying the onset of an infection or an infectious clinical condition caused by a beta coronavirus in a subject comprising administering to the subject the recombinant polypeptide of any one of aspects 1-18, the polypeptide encoded by the recombinant polynucleotide of any one of aspects 19-22, or the pharmaceutical composition of any one of aspects 23-27.

(31) A method for inducing an immune response against a beta coronavirus in a subject comprising administering to the subject the recombinant polypeptide of any one of aspects 1-18, the polypeptide encoded by the recombinant polynucleotide of any one of aspects 19-22, or the pharmaceutical composition of any one of aspects 23-27.

(32) The method of aspect 30 or 31, wherein the recombinant polypeptide of any one of aspects 1-18, the polypeptide encoded by the recombinant polynucleotide of any one of aspects 19-22, or the pharmaceutical composition of any one of aspects 23-27 is administered by oral, parenteral, subcutaneous, intravenous, intramuscular, intranasal, intrapulmonary, intraarterial, intrathecal, or interperitoneal administration.

(33) The method of any one of aspects 30-32, wherein the coronavirus is selected from the group consisting of SARS-CoV-2, SARS-CoV, and MERS-CoV.

(34) The method of any one of aspects 30-33, wherein the subject is a mammal, preferably a human or non-human primate.

(35) The use of the recombinant polypeptide of any one of aspects 1-18, the polypeptide encoded by the recombinant polynucleotide of any one of aspects 19-22, or the pharmaceutical composition of any one of aspects 23-27 for the preparation of a medicament for the treatment or prevention of illness caused by SARS-CoV-2.

(36) The recombinant polypeptide of any one of aspects 1-18, the polypeptide encoded by the recombinant polynucleotide of any one of aspects 19-22, or the pharmaceutical composition of any one of aspects 23-27 for use as a medicament.

EXAMPLES

The following descriptions of cloning and protein expression apply to each example.

Cloning: Inserts encoding a certain fragment of SARS CoV-2 virus Spike protein 51 were designed based prediction and previous Lytic Solutions expression data. Codon optimized cDNA was synthesized. The insert was cloned using either (a) restriction digests and DNA ligations or (b) NEB HiFi DNA assembly builder mix into a pcDNA3.1 vector containing appropriate secretion signal sequences, linkers, and tags for secreted fusion protein expression, as well as sequence encoding a human IgG1 Fc region. The resulting clone encoding a recombinant SARS CoV-2 Spike protein fragment-Fc region fusion protein ("recombinant CoV-2 fusion protein") was verified by either colony PCR and/or restriction digests. DNA sequencing was also used.

Protein Expression: Supercoiled plasmid of the verified clone was transiently transfected into CHO-S cells and expressed under the control of a constitutive promoter within cell culture conditions ranging from 30-37° C. and 3-10 days in $CO_2$ (8%) incubators with rotary shaking agitation at speeds of 150 RPM. Cells were removed by centrifugation and culture medium containing the recombinant CoV-2 fusion protein were passed over Protein A agarose to bind the Fc region-containing CoV-2 protein. Filtration could also have been used to remove cells. The column containing bound recombinant CoV-2 fusion protein was washed with phosphate buffered saline. The recombinant CoV-2 fusion protein bound to the Protein A column was eluted with low pH glycine followed by neutralization in pH8.0 Tris. The recombinant CoV-2 fusion protein was dialyzed to remove glycine/tris and placed into HEPES-buffered saline (10 mM HEPES. 150 mM NaCl, pH adjusted with NaOH to pH 7.2-7.5). No additional purification was employed in this case. However, additional purification by any chromatography method such as HIC or ion exchange can optionally be used.

Example 1

SARS CoV-2 antigens were selected from the genomic sequence (ncbi.nlm.nih.gov/nuccore/MN908947) to use in generating antibody and T-cell responses to the receptor binding domains of SARS CoV-2 virus Spike protein. The selected domain encoding regions were codon optimized for CHO cell expression using IDTDNA codon optimization algorithms. Template DNA was synthesized at Twist Bio. A modified pcDNA3.1 vector was used for protein expression that included human IgG1 Fc for translational fusion generation, i.e., a fusion protein containing a SARS CoV-2 virus Spike protein fragment and an antibody Fc region. The vector encoding the fusion protein was expressed in CHO cells, in which the fusion protein was secreted to the media, cells and cell debris were removed by centrifugation, the recombinant protein was captured with Protein A resin, and eluted with low pH glycine buffer. The resulting fusion protein was buffer exchanged by dialysis and mixed with adjuvant. The resulting vaccine composition was injected intramuscularly into Cynomolgus monkeys. The vaccine composition generated an unexpectedly strong immune response in Cynomolgus monkeys.

Vaccination: Following protein expression in accordance with the description above, the purified recombinant CoV-2 fusion protein (LS2330, CTD_short-a-Fc; SEQ ID NO: 73) was mixed with Titermax Gold adjuvant, a modified squalene in water emulsion adjuvant, according to manufacturer directions, and injected intramuscularly into the thigh of Cynomolgus monkeys. Injections were performed at day 0 and day 14. Dosages were 250 ug of antigen of CTD_short-a-Fc (Seq ID NO:73). Prior to the first injection on day 0, a baseline sample was collected from each test subject.

The immune response was monitored every two weeks following the injection on day 0, with the earliest sample taken on day 14. Accordingly, samples were collected on day 14 and day 28. The samples were analyzed, and the results are shown in FIG. 1. Venous blood was obtained from Cynomolgus monkeys pre immunization in EDTA-containing vacutubes (value shown as Day 0 serum sample in FIG. 1). Immediately after the pre-immunization blood sample was taken, monkeys were immunized with CTD_short-a-Fc (Seq ID NO:73). Serum was isolated by centrifugation of the non-coagulated blood. Serum was diluted 1:100 and analyzed on Intuitive Biosciences ELISA platform for anti-S1 spike binding antibodies. Additional time points were taken at 2 weeks post Day 0, 4 weeks post Day 0, and 6 weeks post Day 0. The single immune boost (CTD_short-a-Fc (Seq ID NO:73)) was performed immediately after the 2 week blood sample was taken. Samples were processed similar to Day 0 samples and immune response was recorded as Relative Intensity Units (RIU) on Intuitive Bioscience ELISA platform. Capture of anti-SARS CoV-2 antibodies was performed by spotting SARS CoV-2 S1 spike protein (Sino Biologicals) onto the wells of Intuitive Bioscience ELISA platform 96 well plates, adding diluted serum—full concentration serum and dilutions to 1:200 serum:buffer were used, but higher concentrations of serum surprisingly resulted in a signal too strong to read on the platform, thus requiring a 1:200 fold dilution for the readings shown in FIG. 1—and incubating for 10-120 minutes to allow binding of anti-CTD antibodies to the S1 spike protein attached to the plate wells. Serum was washed 3× form the wells, and followed by application of anti-cynomolgus detection antibody to the well, incubated for 10-120 minutes, then washed 3× from the well. Detection reagents were added and the signal was quantified compared to control spots of unrelated proteins.

FIG. 1 depicts an unexpectedly strong immune response in Cynomolgus monkeys to the tested construct, particularly in comparison to the immune response generated by other known SARS-CoV-2 constructs. See, for instance, Graham et al., "Evaluation of the immunogenicity of prime-boost vaccination with the replication-deficient viral vectored COVID-19 vaccine candidate ChAdOx1 nCoV-19," bioRxiv preprint doi: doi.org/10.1101/2020.06.20.159715 (posted Jun. 20, 2020)

Figure 5A:
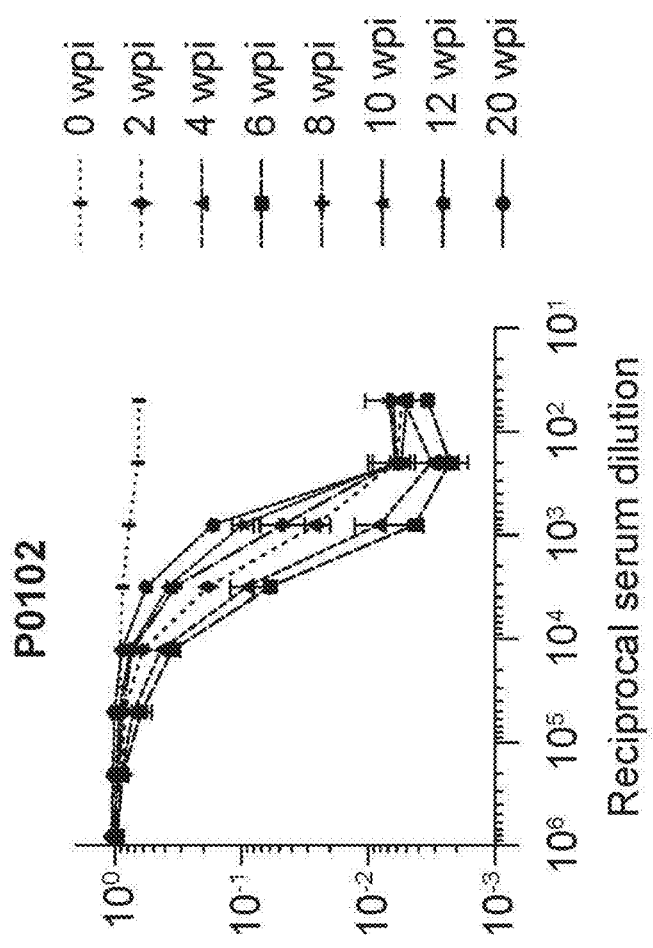
FIGS. 5A, 5B, and 5C are graphs showing the results of neutralization assays using serum samples from animals P0101(FIG. 5A) and P0102 (FIG. 5B) immunized with SEQ ID NO: 73 (LS2330 [CTD_short_a-Fc], which were the subject of analysis discussed in Example 1.
Figure 5B:
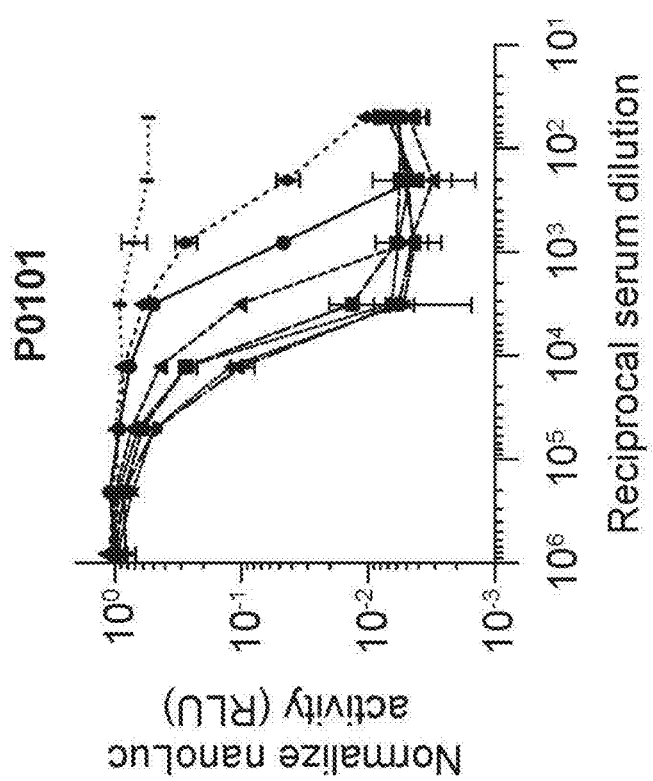
Figure 5C:
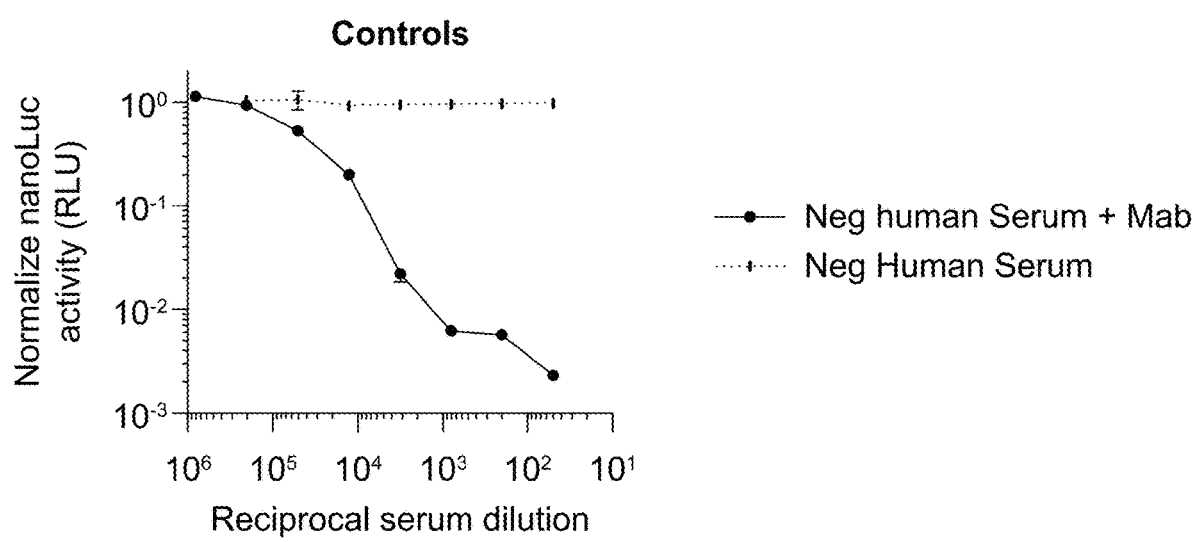

Neutralization Assays: FIGS. 5A-C depict the results of neutralization assays done on the tested Cynomolgus monkeys P0101 and P0102 (respectively depicted as "Animal 101" and "Animal 102" in FIG. 1). Regarding FIGS. 5A and 5B, "wpi" in the legend denotes weeks post injection/immunization. SARS-CoV-2 pseudotyped particles were generated as previously described (see Schmidt, F., et al. Measuring SARS-CoV-2 neutralizing antibody activity using pseudotyped and chimeric viruses. *J Exp Med*, v. 217, n. 11, 11 2020). Briefly, 293T cells were transfected with pHIV-1NLGagPol, pCCNG/nLuc and pSARS-CoV-2-SΔ19. Particles were harvested 48 hours after transfection, filtered and stored at −80° C. Fourfold serially diluted serum from the immunized monkeys was incubated with SARS-CoV-2 pseudotyped virus for 1 h at 37° C. The mixture was subsequently incubated with 293T/ACE2c1.22 cells (plated on Poly-D-Lysine-coated 96-well plates) with the final starting dilution of serum being 1:50. At 48 h later the cells were washed with PBS and lysed with Luciferase Cell Culture Lysis 5× reagent (Promega). Nanoluc Luciferase activity in lysates was measured using the Nano-Glo Luciferase Assay System (Promega) with the Modulus II Microplate Reader (Turner BioSystems). The raw nanoluc luciferase activity values (relative luminescence units) were normalized to those derived from cells infected with SARS-CoV-2 pseudotyped virus in the absence of serum or a rabbit monoclonal antibody diluted in normal human serum at 0.105 mg/mL (40592-R001, Sinobiological, Wayne, PA). The half-maximal inhibitory concentration for serum (NT50) was determined using four-parameter nonlinear regression (GraphPad Prism).

Immunization of the two Cynomolgus macaques (IDs: P0101 and P0102) with SEQ ID NO: 73 (LS2330 [CTD_short_a-Fc] produced robust neutralizing antibody response. Neutralization assays were performed using a replication-defective single-cycle pseudotyped virus carrying SARS-CoV-2 spikes and the NanoLuc luciferase reporter. This assay has been previously shown to accurately predict serum neutralizing activity against authentic SARS-CoV-2 (see Schmidt, F., et al. referenced above). As a control for neutralization sensitivity, human serum obtained from a SARS-CoV-2 negative individual was used alone or spiked with a monoclonal neutralizing antibody (FIG. 5C). Serum samples collected at the various timepoints from 0 to 20 weeks post-immunization were evaluated for neutralizing activity. Sera from animals immunized with SEQ ID NO: 73 (LS2330 [CTD_short_a-Fc] had readily detectable neutralization activity, as early as 2 weeks post-immunization that significantly increased until weeks 4 to 8 of the study. Indeed, neutralizing titers were exceptionally high at 4-8 weeks after immunization, in the range of 10,000 to 100,000 and were maintained in the 1000 to 10,000 range at 20 weeks after immunization.

Example 2

Overview: SARS CoV-2 antigens were selected from the SARS CoV-2 genomic sequence (ncbi.nlm.nih.gov/nuccore/MN908947) to use in generating antibody and T-cell responses to the receptor binding domains of SARS CoV-2 virus Spike protein. Preliminary data identified select individual regions of the SARS CoV-2 virus Spike protein that would be amenable to high-level expression as Fc-fusions, that are resistant to proteolysis when expressed in CHO cells, and that generate strong immune response in Cynomolgus macaques. We further determined that in-series multimerization of select SARS CoV-2 virus Spike protein domains can be used to create proteins that retain high-level expression without significant proteolysis sensitivity whilst doubling the theoretical antigenicity of the molecule to be used for immune stimulation. The design of the multiple domain molecules provides a scaffold for straight-forward modification to incorporate amino acid mutations identified in new and emerging variants of the SARS CoV-2 virus Spike protein. The resulting vaccine composition of the Wuhan variant was injected intramuscularly into Rhesus macaques and elicit stronger immune responses using simple adjuvants at doses at mere fractions of that needed with single domain Fc-fusions.

Figure 3:
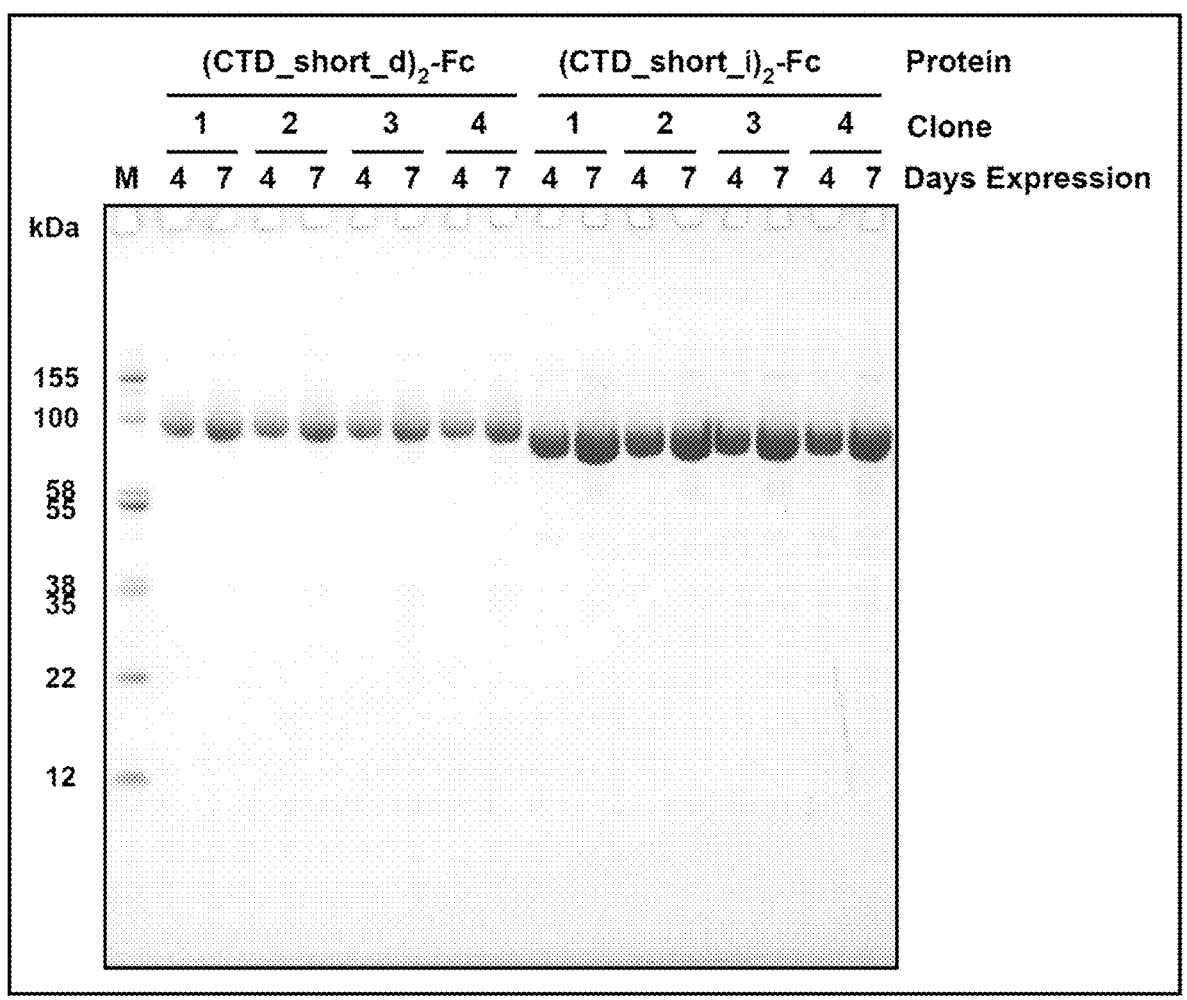
FIG. 3 is an image showing CHO cell expression of (CTD_short_d)$_2$-Fc (clone 1 through 4 correspond to strains LS2397 through 2400; SEQ ID NO: 161) and (CTD_short_i)$_2$-Fc (clone 1 through 4 correspond to strains LS2401 through 2404; SEQ ID NO: 163) after 4 or 7 days as indicated. Protein was affinity purified using Protein A agarose from equal volumes of transfected culture. Eluted protein was loaded based on volume, separated by reducing SDS-PAGE, and detected by Coomassie R-250 staining. M-Molecular weight markers.
Figure 4:
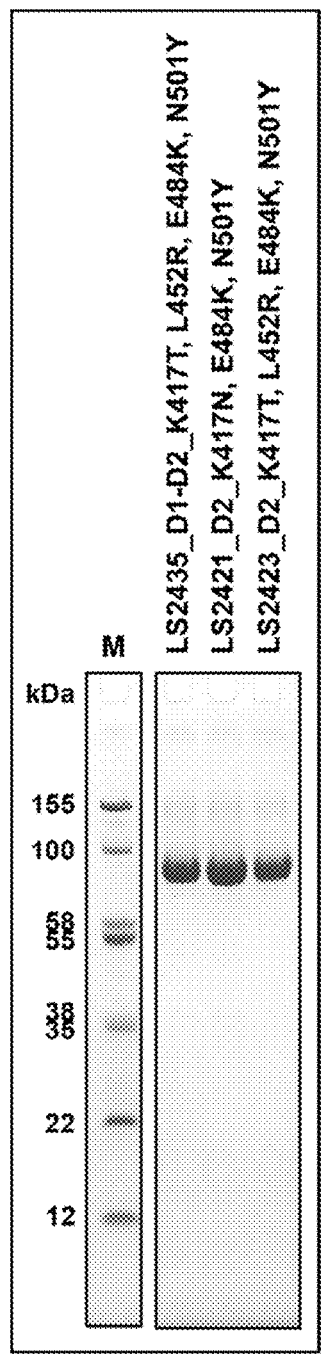
FIG. 4 is an image showing CHO cell expression of mutant (CTD_short_i)$_2$-Fc constructs wherein amino acid mutations corresponding to newly identified SARS-CoV-2 variants have been added to both CTD domains (D1 and D2) or second domain (D2) only of the CTD dimer. The mutants tested include (a) D1 and D2 mutations for hybrid P.1 and CAL.20C variants; K417T, L452R, E484K, N501Y (Strain 2435), (b) D2 mutations for 501.V2 variant/B.1.351, K417N, E484K, N501Y (Strains 2421), and (c) D2 mutations for hybrid P.1 and CAL.20C variants; K417T, L452R, E484K, N501Y (Strain 2423). Protein was affinity purified using Protein A agarose from equal volumes of 4-day transfected culture. Eluted protein was loaded based on volume, separated by reducing SDS-PAGE, and detected by Coomassie R-250 staining. M-Molecular weight markers. Protein loads were 3.48 (strain 2435), 4.52 (strain 2421), and 3.14 µg (strain 2423).

Following protein expression in accordance with the description above, resulting protein was analyzed by reducing SDS-PAGE to determine protein integrity for monomeric CTD-Fcs (FIGS. 2A-D), in-series dimer CTD-Fcs (FIG. 3) and in-series dimer mutant CTD-Fcs (FIG. 4). Protein yields were calculated using absorbance of 280 nm light and protein-specific extinction coefficients determined in silico according to their expected amino acid composition. Representative protein yields are given in Table 1.

TABLE 1

| Strain(s) | Insert | Expression (mg protein/L CHO culture (±SD)) |
|---|---|---|
| 3472 (SEQ ID NO: 75) | CTD_long_a (SEQ ID NO: 1) | 77.3 [5] |
| 2356 (SEQ ID NO: 101) | CTD_long_b (SEQ ID NO: 7) | 60.8 [5] |
| 2357 (SEQ ID NO: 103) | CTD_long_c (SEQ ID NO: 9) | 60.8 [5] |
| 2358 (SEQ ID NO: 105) | CTD_long_d (SEQ ID NO: 11) | 65.8 [5] |
| 2359 (SEQ ID NO: 107) | CTD_long_e (SEQ ID NO: 13) | 96.1 [5] |
| 2360 (SEQ ID NO: 109) | CTD_long_f (SEQ ID NO: 15) | 95.1 [5] |
| 2361 (SEQ ID NO: 111) | CTD_long_g (SEQ ID NO: 17) | 74.5 [5] |
| 2362 (SEQ ID NO: 113) | CTD_long_h (SEQ ID NO: 19) | 108.3 [5] |
| 2363 (SEQ ID NO: 115) | CTD_long_i (SEQ ID NO: 21) | 108.5 [5] |
| 2330 (SEQ ID NO: 73) | CTD_short_a (SEQ ID NO: 23) | >40 [5] |
| 2364 (SEQ ID NO: 117) | CTD_short_b (SEQ ID NO: 25) | 131.8 [5] |
| 2365 (SEQ ID NO: 119) | CTD_short_c (SEQ ID NO: 27) | 126.5 [5] |
| 2366 (SEQ ID NO: 121) | CTD_short_d (SEQ ID NO: 29) | 106.2 [5] |
| 2367 (SEQ ID NO: 123) | CTD_short_e (SEQ ID NO: 31) | 107.5 [5] |
| 2368 (SEQ ID NO: 125) | CTD_short_f (SEQ ID NO: 33) | 109.9 [5] |

TABLE 1-continued

| Strain(s) | Insert | Expression (mg protein/L CHO culture (±SD)) |
|---|---|---|
| 2369 (SEQ ID NO: 127) | CTD_short_g (SEQ ID NO: 35) | 132.4 [5] |
| 2370 (SEQ ID NO: 129) | CTD_short_h (SEQ ID NO: 37) | 67.5 [5] |
| 2371 (SEQ ID NO: 131) | CTD_short_i (SEQ ID NO: 39) | 167.7 [5] |
| 2372 (SEQ ID NO: 133) | CTD_vs_a (SEQ ID NO: 41) | 2.3 [5] |
| 2373 (SEQ ID NO: 135) | CTD_vs_b (SEQ ID NO: 43) | 1.7 [5] |
| 2374 (SEQ ID NO: 137) | CTD_vs_c (SEQ ID NO: 45) | 0.9 [5] |
| 2375 (SEQ ID NO: 139) | CTD_vs_d (SEQ ID NO: 47) | ≤0.8 [5] |
| 2376 (SEQ ID NO: 141) | CTD_vs_e (SEQ ID NO: 49) | ≤0.8 [5] |
| 2377 (SEQ ID NO: 143) | RBD_a (SEQ ID NO: 51) | ≤0.8 [5] |
| 2378 (SEQ ID NO: 145) | RBD_b (SEQ ID NO: 53) | ≤0.8 [5] |
| 2380 (SEQ ID NO: 149) | RBD_d (SEQ ID NO: 55) | ≤0.8 [5] |
| 2381 (SEQ ID NO: 151) | RBD_e (SEQ ID NO: 57) | 14.5 [5] |
| 2393 (SEQ ID NO: 155) | (RBD-tight)$_2$ (SEQ ID NO: 173) | ≤0.8 [7] |
| 2394 (SEQ ID NO: 157) | (RBD-extended)$_2$ (SEQ ID NO: 177) | 7.4 [7] |
| 2395 ((SEQ ID NO: 159) | (RBD)$_2$ (SEQ ID NO: 181) | ≤0.8 [7] |
| 2397-2400 (SEQ ID NO: 161) | (CTD_short_d)$_2$ (SEQ ID NO: 183) | 32.2 [4]/53.0 (±4) [7] |
| 2401-2404 (SEQ ID NO: 163) | (CTD_short_i)$_2$ (SEQ ID NO: 185) | 88.3 [4]/144.7 (±5.5) [7] |
| 2421 (SEQ ID NO: 165) | [(CTD_short_i)$_2$-Fc; D2 mutations for 501.V2 variant, K417N, E484K, N501Y] (SEQ ID NO: 187) | 79.5 [4] |
| 2423 (SEQ ID NO: 167) | [(CTD_short_i)$_2$-Fc; D2 mutations for hybrid P.1 and CAL.20C variants; K417T, L452R, E484K, N501Y] (SEQ ID NO: 189) | 55.2 [4] |
| 2435 (SEQ ID NO: 169) | [(CTD_short_i)$_2$-Fc; D1 and D2 mutations for hybrid P.1 and CAL.20C variants; K417T, L452R, E484K, N501Y] (SEQ ID NO: 191) | 61.2 [4] |

[4] 4-day expression,
[5] 5-day expression,
[7] 7-day expression

Based on the desire to develop methods to increase the relative antigen content of a protein molecule, in-series concatemers of RBD-containing protein fragments translationally fused to an Fc. CTD_short_d and CTD_short_i (SEQ ID NOs: 29 and 39, respectively) were prepared and selected for in-series expression given their high-level, protease resistant expression as monomers. When conjoined with a serine-glycine linker and expressed in CHO cells, the resulting double-domain proteins expressed at similar levels as the monomer constructs. In addition, the in-series design retained the molecular resistance to proteolysis during expression and purification. Therefore, by combining intramolecular dimerization driven by Fc interactions with in-series domain expression, it was possible to go from a single SARS-CoV-2 antigen fragment per molecule to having 4 (and potentially more) per molecule. The higher antigen content in conjunction with robust expression levels and protein stability provides a suitable framework for an immunogen to be used for vaccine and boost applications.

As an example of this approach, double-domain Fc-fusion constructs (i.e., recombinant polypeptides containing two immunogenic fragments connected to an antibody Fc region) containing amino acid mutations within one or both of the domains were prepared. The mutations used were either from a single virus variant or a hybrid of two virus variants. Incorporation of the mutations into the double-domain-Fc wild-type molecule (strain 2401) depicted in FIG. 3 followed by expression in CHO cells resulted in intact, soluble protein with similar yields to the wild-type amino acid sequence. These results support the concept that this multi-domain Fc-fusion platform provides a robust scaffold for the incorporation and expression molecules that reflect new variant mutations. This provides a robust, timely and cost-effective system to adapt vaccine composition to meet the needs to mitigate evolving variants. A vaccine containing strain 2401 was subsequently tested in Rhesus macque monkeys.

Vaccination: Vaccination and boosters to nCoV-2 double dimer (Lytic Solutions Strain #2401, SEQ ID NO: 163, administered to all animals except for those indicated to be administered the nCoV-2 quadruple mutant vaccine) or nCoV-2 quadruple mutant vaccine (Lytic Solutions Strain #2435, SEQ ID NO: 169, referred to in Table 2C as "Variant COVID Vaccine" in Adjuvant & Dose column) were performed on Rhesus macaque monkeys by the following methodology. 50, 25, or 12.5 micrograms (these numbers are used to define dosage) of nCoV-2 protein was mixed with either AS03 (Invivogen catalog vac-as03-10) or alum (Invivogen catalog vac-alu-250) as a 1:1 volume mixture protein:adjuvant. For 50 ug doses 500 ul of each protein and adjuvant were used, for 25 ug and 12.5 ug 250 ul of each protein and adjuvant were used. Dosages were split and injected intramuscularly into left and right thighs at the time of initial vaccination and at booster vaccination. Initial vaccination day was designated day 0. Boosters were given 28 day post day 0 unless otherwise noted. Serum samples were taken prior to initial vaccination on day 0, day 14, day 28 prior to booster vaccination, and day 42 and day 56 were 2/4 weeks post booster injection. Therefore data from 14 and 28 (immunization plus 2 weeks and immunization plus 4 weeks, respectively) days are specific to a single dose of vaccine whereas samples from day 42 and day 56 are 2 doses of vaccine (booster plus 2 weeks, and booster plus 4 weeks respectively). Each animal received the same dosage of protein and adjuvant for the booster dose that they received in the primary dose.

Analysis of antibody titers were performed at Intuitive Biosciences, Madison WI on their proprietary ELISA system (918 Deming Way, Suite 100, Madison WI 53719 USA). Serum was serially diluted in CSA buffer (Intuitive product no. 7-1037) to dilutions of 1:100, 1:1000, 1:10,000, 1:100, 000, and 1:1,000,000. Analysis was performed at and by Intuitive Biosciences. ELISA units are measured as density on their platform with a maximum signal of approximately 45,000-50,000 counts. Titer signals were determined from dilutions that yielded signals less than ⅓rd maximal signal. Fifteen animals were used to determine vaccine/booster efficacy. Animal names are codes generated for each animal at the primate facility at UW-Madison. All animals were assayed through day 56 post initial vaccination. 50, 25, and 12.5 ug doses gave similar titers for day 28. Some animals were followed past the study design point of 56 days to various time points up to 23 weeks post initial vaccine (due to continued potency of vaccine response). Data is summarized in Tables 2A, 2B, and 2C. It is noted that, although some of the Plate Sample ID numbers are overlapping, e.g., Tables 2A and 2B both have a row with a plate sample ID of 59, this is merely an artifact of the data collection process, such that rows with the same Plate Sample ID represent independently collected data points.

50 ug, 25 ug, 12.5 ug: These data show that relatively low dosages of the tested constructs, including 12.5 ug, still elicited sufficient immune stimulation and/or boosting. Such low amounts of protein per vaccine dose allow for an increased number of active doses to be produced per liter of cell culture. As production levels increase, not only do cost of goods go down, but the timeframe to produce large numbers of doses can be decreased in comparison to vaccine compositions requiring higher amounts of protein per dose to provide sufficient immune protection. This is particularly relevant to providing immune protection against any newly-arising SARS-CoV-2 strains.

The assembly of four point-mutations into a single RBD polypeptide was undertaken prior to public disclosure of the Delta mutant isolated first in India. Vaccine LS2435 (SEQ ID NO: 169) contains mutations in four sites that reflect mutation that evolved from new variants identified from the UK, South Africa, Brazil and southern California. Convergent evolution of mutations in new variants lead this to be an attractive approach of stacking multiple mutations in one construct to represent multiple variants, such as seen in the Delta variant. Each RBD point mutation was determined to add virulency through either immune system avoidance or enhanced viral entry or production of higher viral loads (or a combination thereof). The identified mutations were combined to develop a vaccine that could address each mutation and immune epitope singly or in combination. When evolutionary boundaries are considered, it became clear that mutational stacking was likely to take place through either recombination of previous viral strains, or additional mutations stacked onto previous viral strains that enhanced virulence/transmission. Considering the mutation-stacked SARS CoV-2 strains can evade the immune response as well as generate a more potent viral titer, having a vaccine that displays high levels of antibody and T-cell potency is a major advantage over previous COVID-19 vaccines which can provide less potent immune responses to these mutants. The SARS CoV-2 mutant-containing vaccine LS2435 demonstrates highly potent immune stimulation and antibody production in Rhesus macaques. In fact, the levels of antibodies achieved with the mutant vaccine are similar to responses seen from the tested wild-type vaccine, i.e., LS2401.

TABLE 2A

| Plate Sample ID | Spike S1 | Spike S2 | Nucleocapsid | Dilution | Animal - Adjuvant & Dosage | Days post injection |
|---|---|---|---|---|---|---|
| 59 | 14 | 217 | 296 | 1:100 | BH56 - AS03 50 ug | 0 |
| 60 | 19 | 21 | 418 | 1:1,000 | BH56 - AS03 50 ug | 0 |
| 61 | 0 | 30 | 100 | 1:10,000 | BH56 - AS03 50 ug | 0 |
| 62 | 44982 | 343 | 489 | 1:100 | BH56 - AS03 50 ug | 14 |
| 63 | 31862 | 49 | 445 | 1:1,000 | BH56 - AS03 50 ug | 14 |
| 64 | 3227 | 28 | 276 | 1:10,000 | BH56 - AS03 50 ug | 14 |
| 65 | 47053 | 507 | 642 | 1:100 | BH56 - AS03 50 ug | 28 |
| 66 | 35647 | 42 | 46 | 1:1,000 | BH56 - AS03 50 ug | 28 |
| 67 | 9818 | 57 | 290 | 1:10,000 | BH56 - AS03 50 ug | 28 |
| 68 | 34 | 116 | 508 | 1:100 | BC43 - Alum 50 ug | 0 |
| 69 | 0 | 30 | 291 | 1:1,000 | BC43 - Alum 50 ug | 0 |
| 70 | 22 | 52 | 1 | 1:10,000 | BC43 - Alum 50 ug | 0 |
| 71 | 36334 | 67 | 208 | 1:100 | BC43 - Alum 50 ug | 14 |
| 72 | 14375 | 720 | 553 | 1:1,000 | BC43 - Alum 50 ug | 14 |
| 73 | 234 | 0 | 0 | 1:10,000 | BC43 - Alum 50 ug | 14 |
| 74 | 46731 | 20 | 36 | 1:100 | BC43 - Alum 50 ug | 28 |
| 75 | 39535 | 56 | 258 | 1:1,000 | BC43 - Alum 50 ug | 28 |
| 76 | 5458 | 17 | 1 | 1:10,000 | BC43 - Alum 50 ug | 28 |
| 77 | 0 | 97 | 318 | 1:100 | BH95 - Alum 50 ug | 0 |

TABLE 2A-continued

| Plate Sample ID | Spike S1 | Spike S2 | Nucleocapsid | Dilution | Animal - Adjuvant & Dosage | Days post injection |
|---|---|---|---|---|---|---|
| 78 | 0 | 66 | 146 | 1:1,000 | BH95 - Alum 50 ug | 0 |
| 79 | 1 | 12 | 23 | 1:10,000 | BH95 - Alum 50 ug | 0 |
| 80 | 42119 | 63 | 259 | 1:100 | BH95 - Alum 50 ug | 14 |
| 81 | 30356 | 59 | 644 | 1:1,000 | BH95 - Alum 50 ug | 14 |
| 82 | 451 | 0 | 0 | 1:10,000 | BH95 - Alum 50 ug | 14 |
| 83 | 49046 | 156 | 63 | 1:100 | BH95 - Alum 50 ug | 28 |
| 84 | 40830 | 0 | 187 | 1:1,000 | BH95 - Alum 50 ug | 28 |
| 85 | 7282 | 28 | 78 | 1:10,000 | BH95 - Alum 50 ug | 28 |
| 86 | 40 | 55 | 557 | 1:100 | BG86 - AS03 50 ug | 0 |
| 87 | 40 | 93 | 766 | 1:1,000 | BG86 - AS03 50 ug | 0 |
| 88 | 0 | 27 | 229 | 1:10,000 | BG86 - AS03 50 ug | 0 |
| 89 | 27694 | 144 | 618 | 1:100 | BG86 - AS03 50 ug | 14 |
| 90 | 436 | 114 | 275 | 1:1,000 | BG86 - AS03 50 ug | 14 |
| 91 | 243 | 23 | 91 | 1:10,000 | BG86 - AS03 50 ug | 14 |
| 92 | 46656 | 85 | 618 | 1:100 | BG86 - AS03 50 ug | 28 |
| 93 | 38813 | 84 | 527 | 1:1,000 | BG86 - AS03 50 ug | 28 |
| 94 | 13019 | 61 | 65 | 1:10,000 | BG86 - AS03 50 ug | 28 |
| Neg Cntl | 46 | 475 | 986 | | | |
| Pos Cntl | 44473 | 39802 | 31871 | | | |

TABLE 2B

| Plate Sample ID | Spike S1 | Spike S2 | Nucleocapsid | Dilution | Animal - Adjuvant & Dosage | Time after initial vaccination |
|---|---|---|---|---|---|---|
| 10 | 47883 | 0 | 96 | 1:10,000 | BC43 - Alum 50 ug | Day 42 |
| 11 | 25917 | 0 | 0 | 1:100,000 | BC43 - Alum 50 ug | Day 42 |
| 12 | 3597 | 14 | 0 | 1:1,000,000 | BC43 - Alum 50 ug | Day 42 |
| 13 | 45232 | 0 | 60 | 1:10,000 | BC43 - Alum 50 ug | Day 56 |
| 14 | 16743 | 0 | 0 | 1:100,000 | BC43 - Alum 50 ug | Day 56 |
| 15 | 2099 | 0 | 0 | 1:1,000,000 | BC43 - Alum 50 ug | Day 56 |
| 16 | 47513 | 156 | 7 | 1:10,000 | BH56 - AS03 50 ug | Day 42 |
| 17 | 24243 | 31 | 21 | 1:100,000 | BH56 - AS03 50 ug | Day 42 |
| 18 | 3976 | 11 | 0 | 1:1,000,000 | BH56 - AS03 50 ug | Day 42 |
| 19 | 45909 | 0 | 31 | 1:10,000 | BH56 - AS03 50 ug | Day 56 |
| 20 | 18140 | 26 | 5 | 1:100,000 | BH56 - AS03 50 ug | Day 56 |
| 21 | 1184 | 2 | 0 | 1:1,000,000 | BH56 - AS03 50 ug | Day 56 |
| 22 | 44095 | 53 | 0 | 1:10,000 | BH95 - Alum 50 ug | Day 42 |
| 23 | 20940 | 26 | 0 | 1:100,000 | BH95 - Alum 50 ug | Day 42 |
| 24 | 1845 | 2 | 28 | 1:1,000,000 | BH95 - Alum 50 ug | Day 42 |

TABLE 2B-continued

| Plate Sample ID | Spike S1 | Spike S2 | Nucleocapsid | Dilution | Animal - Adjuvant & Dosage | Time after initial vaccination |
|---|---|---|---|---|---|---|
| 25 | 45464 | 67 | 177 | 1:10,000 | BH95 - Alum 50 ug | Day 56 |
| 26 | 17409 | 21 | 5 | 1:100,000 | BH95 - Alum 50 ug | Day 56 |
| 27 | 1281 | 22 | 0 | 1:1,000,000 | BH95 - Alum 50 ug | Day 56 |
| 28 | 48319 | 71 | 0 | 1:10,000 | BC11 - AS03 50 ug | Day 42 |
| 29 | 30010 | 10 | 0 | 1:100,000 | BC11 - AS03 50 ug | Day 42 |
| 30 | 671 | 14 | 0 | 1:1,000,000 | BC11 - AS03 50 ug | Day 42 |
| 31 | 16796 | 4 | 0 | 1:10,000 | BG86 - AS03 50 ug | Single dose 8 weeks |
| 32 | 1550 | 11 | 56 | 1:100,000 | BG86 - AS03 50 ug | Single dose 8 weeks |
| 33 | 164 | 17 | 6 | 1:1,000,000 | BG86 - AS03 50 ug | Single dose 8 weeks |
| 34 | 0 | 64 | 15 | 1:1,000 | BI37 - Alum 25 ug | Day 0 |
| 35 | 2 | 5 | 0 | 1:10,000 | BI37 - Alum 25 ug | Day 0 |
| 36 | 8 | 6 | 25 | 1:100,000 | BI37 - Alum 25 ug | Day 0 |
| 37 | 40318 | 112 | 0 | 1:1,000 | BI37 - Alum 25 ug | Day 14 |
| 38 | 4456 | 35 | 28 | 1:10,000 | BI37 - Alum 25 ug | Day 14 |
| 39 | 655 | 35 | 17 | 1:100,000 | BI37 - Alum 25 ug | Day 14 |
| 40 | 49137 | 127 | 31 | 1:1,000 | BI37 - Alum 25 ug | Day 28 |
| 41 | 32611 | 29 | 2 | 1:10,000 | BI37 - Alum 25 ug | Day 28 |
| 42 | 5526 | 34 | 0 | 1:100,000 | BI37 - Alum 25 ug | Day 28 |
| 43 | 0 | 56 | 15 | 1:1,000 | BK78 - AS03 25 ug | Day 0 |
| 44 | 36 | 46 | 27 | 1:10,000 | BK78 - AS03 25 ug | Day 0 |
| 45 | 45 | 34 | 0 | 1:100,000 | BK78 - AS03 25 ug | Day 0 |
| 46 | 26462 | 49 | 87 | 1:1,000 | BK78 - AS03 25 ug | Day 14 |
| 47 | 965 | 122 | 29 | 1:10,000 | BK78 - AS03 25 ug | Day 14 |
| 48 | 92 | 28 | 37 | 1:100,000 | BK78 - AS03 25 ug | Day 14 |
| 49 | 36563 | 67 | 31 | 1:1,000 | BK78 - AS03 25 ug | Day 28 |
| 50 | 6352 | 34 | 17 | 1:10,000 | BK78 - AS03 25 ug | Day 28 |
| 51 | 917 | 34 | 60 | 1:100,000 | BK78 - AS03 25 ug | Day 28 |
| 52 | 1 | 0 | 160 | 1:1,000 | BM52- AS03 12.5 ug | Day 0 |
| 53 | 15 | 64 | 60 | 1:10,000 | BM52- AS03 12.5 ug | Day 0 |
| 54 | 12 | 79 | 49 | 1:100,000 | BM52- AS03 12.5 ug | Day 0 |
| 55 | 17806 | 684 | 315 | 1:1,000 | BM52- AS03 12.5 ug | Day 14 |
| 56 | 380 | 147 | 35 | 1:10,000 | BM52- AS03 12.5 ug | Day 14 |
| 57 | 96 | 32 | 18 | 1:100,000 | BM52- AS03 12.5 ug | Day 14 |
| 58 | 39459 | 440 | 29 | 1:1,000 | BM52- AS03 12.5 ug | Day 28 |
| 59 | 4104 | 56 | 12 | 1:10,000 | BM52- AS03 12.5 ug | Day 28 |
| 60 | 467 | 13 | 26 | 1:100,000 | BM52- AS03 12.5 ug | Day 28 |
| 61 | 19 | 51 | 0 | 1:1,000 | BC31 - Alum 12.5 ug | Day 0 |
| 62 | 0 | 0 | 2 | 1:10,000 | BC31 - Alum 12.5 ug | Day 0 |

TABLE 2B-continued

| Plate Sample ID | Spike S1 | Spike S2 | Nucleocapsid | Dilution | Animal - Adjuvant & Dosage | Time after initial vaccination |
|---|---|---|---|---|---|---|
| 63 | 0 | 74 | 30 | 1:100,000 | BC31 - Alum 12.5 ug | Day 0 |
| 64 | 9436 | 123 | 40 | 1:1,000 | BC31 - Alum 12.5 ug | Day 14 |
| 65 | 426 | 27 | 0 | 1:10,000 | BC31 - Alum 12.5 ug | Day 14 |
| 66 | 8 | 31 | 0 | 1:100,000 | BC31 - Alum 12.5 ug | Day 14 |
| 67 | 36234 | 0 | 36 | 1:1,000 | BC31 - Alum 12.5 ug | Day 28 |
| 68 | 7220 | 24 | 14 | 1:10,000 | BC31 - Alum 12.5 ug | Day 28 |
| 69 | 160 | 9 | 8 | 1:100,000 | BC31 - Alum 12.5 ug | Day 28 |
| Neg Cntl | 221 | 1837 | 90 | | | |
| Neg Cntl | 12 | 46 | 10 | | | |
| Pos Cntl | 49197 | 44161 | 45329 | | | |
| Pos Cntl | 47017 | 41224 | 46778 | | | |

TABLE 2C

| Plate Sample ID | Spike S1 | Spike S2 | Nucleocapsid | Dilution | Animal | Days after initial injection | Adjuvant & Dose |
|---|---|---|---|---|---|---|---|
| 1A | 15544 | 333 | 104 | 1:10,000 | BG86 | 84 | AS03 50 ug - single dose |
| 1B | 1751 | 277 | 255 | 1:100,000 | BG86 | 84 | AS03 50 ug - single dose |
| 1C | 481 | 276 | 123 | 1:1,000,000 | BG86 | 84 | AS03 50 ug - single dose |
| 2A | 35682 | 375 | 0 | 1:10,000 | BH56 | 84 | AS03 50 ug |
| 2B | 9450 | 313 | 259 | 1:100,000 | BH56 | 84 | AS03 50 ug |
| 2C | 1697 | 329 | 253 | 1:1,000,000 | BH56 | 84 | AS03 50 ug |
| 3A | 39567 | 327 | 368 | 1:10,000 | BC43 | 84 | Alum 50 ug |
| 3B | 9891 | 95 | 124 | 1:100,000 | BC43 | 84 | Alum 50 ug |
| 3C | 1824 | 272 | 0 | 1:1,000,000 | BC43 | 84 | Alum 50 ug |
| 4A | 37479 | 135 | 718 | 1:10,000 | BH95 | 84 | Alum 50 ug |
| 4B | 8790 | 161 | 143 | 1:100,000 | BH95 | 84 | Alum 50 ug |
| 4C | 1619 | 201 | 132 | 1:1,000,000 | BH95 | 84 | Alum 50 ug |
| 6A | 8417 | 127 | 454 | 1:10,000 | BC11 | 14 | AS03 50 ug |
| 6B | 849 | 179 | 71 | 1:100,000 | BC11 | 14 | AS03 50 ug |
| 6C | 265 | 381 | 273 | 1:1,000,000 | BC11 | 14 | AS03 50 ug |
| 7A | 13381 | 607 | 664 | 1:10,000 | BC11 | 28 | AS03 50 ug |
| 7B | 803 | 176 | 81 | 1:100,000 | BC11 | 28 | AS03 50 ug |
| 7C | 341 | 251 | 275 | 1:1,000,000 | BC11 | 28 | AS03 50 ug |
| 8A | 45422 | 341 | 285 | 1:10,000 | BC11 | 56 | AS03 50 ug |
| 8B | 18249 | 173 | 165 | 1:100,000 | BC11 | 56 | AS03 50 ug |
| 8C | 3752 | 213 | 357 | 1:1,000,000 | BC11 | 56 | AS03 50 ug |
| 9A | 42056 | 341 | 292 | 1:10,000 | BC11 | 84 | AS03 50 ug |
| 9B | 14271 | 316 | 163 | 1:100,000 | BC11 | 84 | AS03 50 ug |
| 9C | 2393 | 256 | 129 | 1:1,000,000 | BC11 | 84 | AS03 50 ug |
| 10A | 44288 | 237 | 150 | 1:10,000 | BI37 | 42 | Alum 25 ug |
| 10B | 19432 | 189 | 119 | 1:100,000 | BI37 | 42 | Alum 25 ug |
| 10C | 4354 | 378 | 231 | 1:1,000,000 | BI37 | 42 | Alum 25 ug |
| 11A | 43800 | 239 | 35 | 1:10,000 | BI37 | 56 | Alum 25 ug |
| 11B | 15355 | 138 | 75 | 1:100,000 | BI37 | 56 | Alum 25 ug |
| 11C | 2865 | 337 | 247 | 1:1,000,000 | BI37 | 56 | Alum 25 ug |
| 12A | 38022 | 305 | 18 | 1:10,000 | BI37 | 84 | Alum 25 ug |
| 12B | 11812 | 294 | 86 | 1:100,000 | BI37 | 84 | Alum 25 ug |
| 12C | 1948 | 213 | 243 | 1:1,000,000 | BI37 | 84 | Alum 25 ug |
| 13A | 46998 | 398 | 167 | 1:10,000 | BK78 | 42 | AS03 25 ug |
| 13B | 24787 | 267 | 116 | 1:100,000 | BK78 | 42 | AS03 25 ug |
| 13C | 6808 | 442 | 0 | 1:1,000,000 | BK78 | 42 | AS03 25 ug |
| 14A | 45244 | 441 | 0 | 1:10,000 | BK78 | 56 | AS03 25 ug |
| 14B | 18294 | 209 | 84 | 1:100,000 | BK78 | 56 | AS03 25 ug |
| 14C | 3830 | 484 | 256 | 1:1,000,000 | BK78 | 56 | AS03 25 ug |
| 15A | 41106 | 478 | 0 | 1:10,000 | BK78 | 84 | AS03 25 ug |
| 15B | 14414 | 275 | 83 | 1:100,000 | BK78 | 84 | AS03 25 ug |
| 15C | 3328 | 435 | 269 | 1:1,000,000 | BK78 | 84 | AS03 25 ug |
| 16A | 46111 | 524 | 779 | 1:10,000 | BM52 | 42 | AS03 12.5 ug |
| 16B | 24586 | 113 | 300 | 1:100,000 | BM52 | 42 | AS03 12.5 ug |
| 16C | 7160 | 223 | 156 | 1:1,000,000 | BM52 | 42 | AS03 12.5 ug |

TABLE 2C-continued

| Plate Sample ID | Spike S1 | Spike S2 | Nucleocapsid | Dilution | Animal | Days after initial injection | Adjuvant & Dose |
| --- | --- | --- | --- | --- | --- | --- | --- |
| 17A | 41733 | 328 | 527 | 1:10,000 | BM52 | 56 | AS03 12.5 ug |
| 17B | 18140 | 284 | 157 | 1:100,000 | BM52 | 56 | AS03 12.5 ug |
| 17C | 3499 | 222 | 380 | 1:1,000,000 | BM52 | 56 | AS03 12.5 ug |
| 18A | 36263 | 995 | 242 | 1:10,000 | BM52 | 84 | AS03 12.5 ug |
| 18B | 11912 | 525 | 277 | 1:100,000 | BM52 | 84 | AS03 12.5 ug |
| 18C | 1679 | 190 | 301 | 1:1,000,000 | BM52 | 84 | AS03 12.5 ug |
| 19A | 43970 | 345 | 37 | 1:10,000 | BC31 | 42 | Alum 12.5 ug |
| 19B | 20155 | 255 | 25 | 1:100,000 | BC31 | 42 | Alum 12.5 ug |
| 19C | 3849 | 321 | 268 | 1:1,000,000 | BC31 | 42 | Alum 12.5 ug |
| 20A | 40779 | 264 | 0 | 1:10,000 | BC31 | 56 | Alum 12.5 ug |
| 20B | 18417 | 298 | 196 | 1:100,000 | BC31 | 56 | Alum 12.5 ug |
| 20C | 2169 | 261 | 24 | 1:1,000,000 | BC31 | 56 | Alum 12.5 ug |
| 21A | 32251 | 89 | 0 | 1:10,000 | BC31 | 84 | Alum 12.5 ug |
| 21B | 9977 | 314 | 197 | 1:100,000 | BC31 | 84 | Alum 12.5 ug |
| 21C | 1521 | 384 | 213 | 1:1,000,000 | BC31 | 84 | Alum 12.5 ug |
| 22A | 43 | 249 | 129 | 1:10,000 | BM21 | 0 | AS03 12.5 ug |
| 22B | 267 | 215 | 186 | 1:100,000 | BM21 | 0 | AS03 12.5 ug |
| 22C | 225 | 270 | 141 | 1:1,000,000 | BM21 | 0 | AS03 12.5 ug |
| 23A | 2694 | 331 | 96 | 1:10,000 | BM21 | 14 | AS03 12.5 ug |
| 23B | 621 | 202 | 190 | 1:100,000 | BM21 | 14 | AS03 12.5 ug |
| 23C | 297 | 339 | 225 | 1:1,000,000 | BM21 | 14 | AS03 12.5 ug |
| 24A | 5672 | 361 | 75 | 1:10,000 | BM21 | 28 | AS03 12.5 ug |
| 24B | 905 | 39 | 168 | 1:100,000 | BM21 | 28 | AS03 12.5 ug |
| 24C | 91 | 129 | 139 | 1:1,000,000 | BM21 | 28 | AS03 12.5 ug |
| 25A | 45613 | 555 | 118 | 1:10,000 | BM21 | 49 | AS03 12.5 ug |
| 25B | 23568 | 513 | 244 | 1:100,000 | BM21 | 49 | AS03 12.5 ug |
| 25C | 4134 | 293 | 248 | 1:1,000,000 | BM21 | 49 | AS03 12.5 ug |
| 26A | 39959 | 429 | 19 | 1:10,000 | BM21 | 63 | AS03 12.5 ug |
| 26B | 15663 | 309 | 161 | 1:100,000 | BM21 | 63 | AS03 12.5 ug |
| 26C | 2263 | 240 | 273 | 1:1,000,000 | BM21 | 63 | AS03 12.5 ug |
| 27A | 34745 | 371 | 47 | 1:10,000 | BM21 | 91 | AS03 12.5 ug |
| 27B | 9926 | 402 | 121 | 1:100,000 | BM21 | 91 | AS03 12.5 ug |
| 27C | 1197 | 299 | 380 | 1:1,000,000 | BM21 | 91 | AS03 12.5 ug |
| 28A | 879 | 302 | 80 | 1:10,000 | BD82 | 0 | Alum 12.5 ug |
| 28B | 538 | 470 | 120 | 1:100,000 | BD82 | 0 | Alum 12.5 ug |
| 28C | 591 | 135 | 129 | 1:1,000,000 | BD82 | 0 | Alum 12.5 ug |
| 29A | 3764 | 90 | 0 | 1:10,000 | BD82 | 14 | Alum 12.5 ug |
| 29B | 532 | 397 | 227 | 1:100,000 | BD82 | 14 | Alum 12.5 ug |
| 29C | 307 | 583 | 267 | 1:1,000,000 | BD82 | 14 | Alum 12.5 ug |
| 30A | 9816 | 337 | 84 | 1:10,000 | BD82 | 21 | Alum 12.5 ug |
| 30B | 2407 | 371 | 169 | 1:100,000 | BD82 | 21 | Alum 12.5 ug |
| 30C | 285 | 462 | 245 | 1:1,000,000 | BD82 | 21 | Alum 12.5 ug |
| 31A | 41086 | 344 | 128 | 1:10,000 | BD82 | 35 | Alum 12.5 ug |
| 31B | 19882 | 159 | 219 | 1:100,000 | BD82 | 35 | Alum 12.5 ug |
| 31C | 2912 | 333 | 73 | 1:1,000,000 | BD82 | 35 | Alum 12.5 ug |
| 32A | 36345 | 245 | 57 | 1:10,000 | BD82 | 49 | Alum 12.5 ug |
| 32B | 13460 | 469 | 264 | 1:100,000 | BD82 | 49 | Alum 12.5 ug |
| 32C | 2585 | 149 | 9 | 1:1,000,000 | BD82 | 49 | Alum 12.5 ug |
| 33A | 27977 | 400 | 185 | 1:10,000 | BD82 | 77 | Alum 12.5 ug |
| 33B | 7948 | 288 | 80 | 1:100,000 | BD82 | 77 | Alum 12.5 ug |
| 33C | 904 | 262 | 28 | 1:1,000,000 | BD82 | 77 | Alum 12.5 ug |
| 34A | 62 | 274 | 150 | 1:10,000 | BE83 | 0 | Alum 25 ug |
| 34B | 385 | 232 | 217 | 1:100,000 | BE83 | 0 | Alum 25 ug |
| 34C | 142 | 306 | 292 | 1:1,000,000 | BE83 | 0 | Alum 25 ug |
| 35A | 3232 | 69 | 94 | 1:10,000 | BE83 | 14 | Alum 25 ug |
| 35B | 804 | 343 | 34 | 1:100,000 | BE83 | 14 | Alum 25 ug |
| 35C | 129 | 222 | 161 | 1:1,000,000 | BE83 | 14 | Alum 25 ug |
| 36A | 8300 | 150 | 58 | 1:10,000 | BE83 | 21 | Alum 25 ug |
| 36B | 1700 | 295 | 153 | 1:100,000 | BE83 | 21 | Alum 25 ug |
| 36C | 266 | 285 | 111 | 1:1,000,000 | BE83 | 21 | Alum 25 ug |
| 37A | 38645 | 368 | 0 | 1:10,000 | BE83 | 35 | Alum 25 ug |
| 37B | 13433 | 320 | 151 | 1:100,000 | BE83 | 35 | Alum 25 ug |
| 37C | 3155 | 306 | 112 | 1:1,000,000 | BE83 | 35 | Alum 25 ug |
| 38A | 35954 | 375 | 67 | 1:10,000 | BE83 | 49 | Alum 25 ug |
| 38B | 14846 | 190 | 89 | 1:100,000 | BE83 | 49 | Alum 25 ug |
| 38C | 3553 | 339 | 246 | 1:1,000,000 | BE83 | 49 | Alum 25 ug |
| 39A | 23360 | 373 | 0 | 1:10,000 | BE83 | 77 | Alum 25 ug |
| 39B | 7836 | 72 | 31 | 1:100,000 | BE83 | 77 | Alum 25 ug |
| 40A | 12128 | 194 | 190 | 1:10,000 | BG86 | 105 | AS03 50 ug - single dose |
| 40B | 2292 | 161 | 159 | 1:100,000 | BG86 | 105 | AS03 50 ug - single dose |
| 40C | 261 | 187 | 191 | 1:1,000,000 | BG86 | 105 | AS03 50 ug - single dose |
| 41A | 10969 | 161 | 0 | 1:10,000 | BG86 | 139 | AS03 50 ug - single dose |

TABLE 2C-continued

| Plate Sample ID | Spike S1 | Spike S2 | Nucleocapsid | Dilution | Animal | Days after initial injection | Adjuvant & Dose |
|---|---|---|---|---|---|---|---|
| 41B | 1875 | 219 | 181 | 1:100,000 | BG86 | 139 | AS03 50 ug - single dose |
| 41C | 992 | 837 | 705 | 1:1,000,000 | BG86 | 139 | AS03 50 ug - single dose |
| 42A | 176 | 57 | 120 | 1:10,000 | BG86 | MILK 1 month post birth | AS03 50 ug - single dose |
| 42B | 567 | 216 | 123 | 1:100,000 | BG86 | MILK 1 month post birth | AS03 50 ug - single dose |
| 42C | 217 | 283 | 153 | 1:1,000,000 | BG86 | MILK 1 month post birth | AS03 50 ug - single dose |
| 43A | 9055 | 140 | 149 | 1:10,000 | BP49 Mother is BG86 | Birth Serum | no vaccine |
| 43B | 1410 | 121 | 235 | 1:100,000 | BP49 Mother is BG86 | Birth Serum | no vaccine |
| 43C | 388 | 311 | 152 | 1:1,000,000 | BP49 Mother is BG86 | Birth Serum | no vaccine |
| 44A | 4525 | 35 | 0 | 1:10,000 | BP49 Mother is BG86 | 4 weeks post birth serum | no vaccine |
| 44B | 1259 | 269 | 40 | 1:100,000 | BP49 Mother is BG86 | 4 weeks post birth serum | no vaccine |
| 44C | 286 | 261 | 223 | 1:1,000,000 | BP49 Mother is BG86 | 4 weeks post birth serum | no vaccine |
| 45A | 23973 | 304 | 97 | 1:10,000 | BC43 | 162 | Alum 50 ug |
| 45B | 4896 | 272 | 161 | 1:100,000 | BC43 | 162 | Alum 50 ug |
| 45C | 649 | 212 | 208 | 1:1,000,000 | BC43 | 162 | Alum 50 ug |
| 46A | 32326 | 192 | 36 | 1:10,000 | BK78 | 142 | AS03 25 ug |
| 46B | 11039 | 336 | 26 | 1:100,000 | BK78 | 142 | AS03 25 ug |
| 46C | 1694 | 418 | 226 | 1:1,000,000 | BK78 | 142 | AS03 25 ug |
| 47A | 21598 | 206 | 0 | 1:10,000 | BM72 | 120 | AS03 25 ug |
| 47B | 5364 | 274 | 237 | 1:100,000 | BM72 | 120 | AS03 25 ug |
| 47C | 496 | 305 | 222 | 1:1,000,000 | BM72 | 120 | AS03 25 ug |
| 48A | 18031 | 166 | 168 | 1:10,000 | BH95 | 162 | Alum 50 ug |
| 48B | 3372 | 304 | 173 | 1:100,000 | BH95 | 162 | Alum 50 ug |
| 48C | 562 | 350 | 191 | 1:1,000,000 | BH95 | 162 | Alum 50 ug |
| 49A | 31501 | 102 | 147 | 1:10,000 | BC11 | 150 | AS03 50 ug |
| 49B | 8850 | 327 | 191 | 1:100,000 | BC11 | 150 | AS03 50 ug |
| 49C | 1716 | 447 | 257 | 1:1,000,000 | BC11 | 150 | AS03 50 ug |
| 50A | 38099 | 414 | 277 | 1:10,000 | BM52 | 142 | AS03 12.5 ug |
| 50B | 16407 | 288 | 305 | 1:100,000 | BM52 | 142 | AS03 12.5 ug |
| 50C | 3171 | 304 | 136 | 1:1,000,000 | BM52 | 142 | AS03 12.5 ug |
| 51A | 358 | 131 | 191 | 1:10,000 | BJ55 | 0 | None - Control |
| 51B | 443 | 363 | 357 | 1:100,000 | BJ55 | 0 | None - Control |
| 51C | 138 | 371 | 117 | 1:1,000,000 | BJ55 | 0 | None - Control |
| 52A | 19609 | 216 | 139 | 1:10,000 | BI37 | 150 | Alum 25 ug |
| 52B | 4058 | 261 | 214 | 1:100,000 | BI37 | 150 | Alum 25 ug |
| 52C | 465 | 148 | 32 | 1:1,000,000 | BI37 | 150 | Alum 25 ug |
| 53A | 31360 | 392 | 175 | 1:10,000 | BH56 | 169 | AS03 50 ug |
| 53B | 8082 | 202 | 146 | 1:100,000 | BH56 | 169 | AS03 50 ug |
| 53C | 1013 | 342 | 97 | 1:1,000,000 | BH56 | 169 | AS03 50 ug |
| 54A | 20996 | 282 | 110 | 1:10,000 | BE83 | 118 | Alum 25 ug |
| 54B | 4122 | 195 | 75 | 1:100,000 | BE83 | 118 | Alum 25 ug |
| 54C | 534 | 319 | 226 | 1:1,000,000 | BE83 | 118 | Alum 25 ug |
| 55A | 433 | 353 | 151 | 1:10,000 | BI98 | 0 | None - Control |
| 55B | 290 | 186 | 114 | 1:100,000 | BI98 | 0 | None - Control |
| 55C | 129 | 297 | 190 | 1:1,000,000 | BI98 | 0 | None - Control |
| 56A | 21633 | 245 | 129 | 1:10,000 | BI21 | 56 | Variant COVID Vaccine AS03 25 ug |

TABLE 2C-continued

| Plate Sample ID | Spike S1 | Spike S2 | Nucleocapsid | Dilution | Animal | Days after initial injection | Adjuvant & Dose |
|---|---|---|---|---|---|---|---|
| 56B | 5705 | 570 | 216 | 1:100,000 | BI21 | 56 | Variant COVID Vaccine AS03 25 ug |
| 56C | 840 | 228 | 155 | 1:1,000,000 | BI21 | 56 | Variant COVID Vaccine AS03 25 ug |
| 57A | 10191 | 173 | 239 | 1:10,000 | BC31 | 148 | Alum 12.5 ug |
| 57B | 1927 | 340 | 170 | 1:100,000 | BC31 | 148 | Alum 12.5 ug |
| 57C | 217 | 480 | 353 | 1:1,000,000 | BC31 | 148 | Alum 12.5 ug |
| 58A | 25739 | 262 | 179 | 1:10,000 | BK44 | 56 | Variant COVID Vaccine AS03 25 ug |
| 58B | 4927 | 278 | 91 | 1:100,000 | BK44 | 56 | Variant COVID Vaccine AS03 25 ug |
| 58C | 1183 | 183 | 113 | 1:1,000,000 | BK44 | 56 | Variant COVID Vaccine AS03 25 ug |
| 59A | 20341 | 177 | 4 | 1:10,000 | BD82 | 118 | Alum 12.5 ug |
| 59B | 3719 | 264 | 238 | 1:100,000 | BD82 | 118 | Alum 12.5 ug |
| 59C | 410 | 377 | 318 | 1:1,000,000 | BD82 | 118 | Alum 12.5 ug |
| 60A | 38868 | 621 | 413 | 1:10,000 | BM52 | 148 | AS03 12.5 ug |
| 60B | 14327 | 303 | 250 | 1:100,000 | BM52 | 148 | AS03 12.5 ug |
| 60C | 1649 | 214 | 132 | 1:1,000,000 | BM52 | 148 | AS03 12.5 ug |
| 61A | 26273 | 155 | 0 | 1:10,000 | BM21 | 125 | AS03 12.5 ug |
| 61B | 5330 | 236 | 108 | 1:100,000 | BM21 | 125 | AS03 12.5 ug |
| 61C | 861 | 340 | 169 | 1:1,000,000 | BM21 | 125 | AS03 12.5 ug |
| 62A | 19650 | 161 | 0 | 1:10,000 | BI21 | 84 | Variant COVID Vaccine AS03 25 ug |
| 62B | 5896 | 307 | 69 | 1:100,000 | BI21 | 84 | Variant COVID Vaccine AS03 25 ug |
| 62C | 747 | 244 | 229 | 1:1,000,000 | BI21 | 84 | Variant COVID Vaccine AS03 25 ug |
| 63A | 20018 | 179 | 39 | 1:10,000 | BK44 | 84 | Variant COVID Vaccine AS03 25 ug |
| 63B | 3860 | 184 | 53 | 1:100,000 | BK44 | 84 | A Variant COVID Vaccine S03 25 ug |
| 63C | 614 | 201 | 54 | 1:1,000,000 | BK44 | 84 | Variant COVID Vaccine AS03 25 ug |
| 66A | 0 | 56 | 131 | 1:10,000 | BK44 | 0 | Variant COVID Vaccine AS03 25 ug |
| 66B | 144 | 450 | 345 | 1:100,000 | BK44 | 0 | Variant COVID Vaccine AS03 25 ug |
| 66C | 224 | 411 | 146 | 1:1,000,000 | BK44 | 0 | Variant COVID Vaccine AS03 25 ug |
| 67A | 1739 | 73 | 60 | 1:10,000 | BK44 | 28 | Variant COVID Vaccine AS03 25 ug |
| 67B | 415 | 306 | 202 | 1:100,000 | BK44 | 28 | Variant COVID Vaccine AS03 25 ug |

TABLE 2C-continued

| Plate Sample ID | Spike S1 | Spike S2 | Nucleocapsid | Dilution | Animal | Days after initial injection | Adjuvant & Dose |
|---|---|---|---|---|---|---|---|
| 67C | 19 | 229 | 161 | 1:1,000,000 | BK44 | 28 | Variant COVID Vaccine AS03 25 ug |
| 68A | 25898 | 257 | 0 | 1:10,000 | BK44 | 56 | Variant COVID Vaccine AS03 25 ug |
| 68B | 7243 | 332 | 446 | 1:100,000 | BK44 | 56 | Variant COVID Vaccine AS03 25 ug |
| 68C | 1135 | 174 | 92 | 1:1,000,000 | BK44 | 56 | Variant COVID Vaccine AS03 25 ug |
| 69A | 11 | 215 | 103 | 1:10,000 | BI21 | 0 | Variant COVID Vaccine AS03 25 ug |
| 69B | 95 | 0 | 50 | 1:100,000 | BI21 | 0 | Variant COVID Vaccine AS03 25 ug |
| 69C | 152 | 165 | 102 | 1:1,000,000 | BI21 | 0 | Variant COVID Vaccine AS03 25 ug |
| 70A | 2679 | 232 | 120 | 1:10,000 | BI21 | 28 | Variant COVID Vaccine AS03 25 ug |
| 70B | 429 | 335 | 2 | 1:100,000 | BI21 | 28 | Variant COVID Vaccine AS03 25 ug |
| 70C | 327 | 1562 | 839 | 1:1,000,000 | BI21 | 28 | Variant COVID Vaccine AS03 25 ug |
| 71A | 22367 | 177 | 31 | 1:10,000 | BI21 | 56 | Variant COVID Vaccine AS03 25 ug |
| 71B | 5939 | 281 | 116 | 1:100,000 | BI21 | 56 | Variant COVID Vaccine AS03 25 ug |
| 71C | 841 | 299 | 142 | 1:1,000,000 | BI21 | 56 | Variant COVID Vaccine AS03 25 ug |
| 72A | 85 | 292 | 16 | 1:10,000 | BM72 | 0 | AS03 25 ug |
| 72B | 331 | 449 | 281 | 1:100,000 | BM72 | 0 | AS03 25 ug |
| 72C | 294 | 312 | 139 | 1:1,000,000 | BM72 | 0 | AS03 25 ug |
| 73A | 4015 | 229 | 162 | 1:10,000 | BM72 | 28 | AS03 25 ug |
| 73B | 764 | 251 | 262 | 1:100,000 | BM72 | 28 | AS03 25 ug |
| 73C | 476 | 499 | 165 | 1:1,000,000 | BM72 | 28 | AS03 25 ug |
| 74A | 35753 | 239 | 39 | 1:10,000 | BM72 | 56 | AS03 25 ug |
| 74B | 13297 | 277 | 123 | 1:100,000 | BM72 | 56 | AS03 25 ug |
| 74C | 2518 | 396 | 126 | 1:1,000,000 | BM72 | 56 | AS03 25 ug |

Example 3

Further constructs containing certain SARS-CoV-2 immunogenic fragments were prepared and expressed in accordance with the methods disclosed herein. See, e.g., the first three paragraphs of the Example section. The protein expression of the constructs was subsequently measured after four days of expression. See Table 3; FIG. 6. All tested constructs expressed at a concentration of at least about 50 mg protein/L culture.

TABLE 3

Protein yields for Protein A affinity-purified BA.X-monomer-Fc proteins after 4-days of expression.

| Strain Number | Protein | mg protein/L culture |
|---|---|---|
| 2634 | BA.X-1-monomer-Fc (SEQ ID NO: 255) | 85.9 |
| 2635 | BA.X-2-monomer-Fc (SEQ ID NO: 256) | 58.3 |

TABLE 3-continued

Protein yields for Protein A affinity-purified BA.X-monomer-Fc proteins after 4-days of expression.

| Strain Number | Protein | mg protein/L culture |
| --- | --- | --- |
| 2636 | BA.X-3-monomer-Fc (SEQ ID NO: 257) | 59.5 |
| 2637 | BA.X-4-monomer-Fc (SEQ ID NO: 258) | 69.3 |
| 2638 | BA.X-5-monomer-Fc (SEQ ID NO: 259) | 47.9 |
| 2639 | BA.X-6-monomer-Fc (SEQ ID NO: 260) | 51.4 |
| 2640 | BA.X-7-monomer-Fc (SEQ ID NO: 261) | 73.4 |
| 2641 | BA.X-8-monomer-Fc (SEQ ID NO: 262) | 91.0 |
| 2642 | BA.X-9-monomer-Fc (SEQ ID NO: 263) | 48.2 |
| 2643 | BA.X-10-monomer-Fc (SEQ ID NO: 264) | 75.7 |

TABLE 4

Mutations within Monomer (with corresponding SEQ ID NO) In Comparison to Wuhan wild-type variant

| Mutation Position | BA.X-1 (245) | BA.X-2 (246) | BA.X-3 (247) | BA.X-4 (248) | BA.X-5 (249) | BA.X-6 (250) | BA.X-7 (251) | BA.X-8 (252) | BA.X-9 (253) | BA.X-10 (254) |
| --- | --- | --- | --- | --- | --- | --- | --- | --- | --- | --- |
| G339 | G339D | G339D | G339D | G339D | G339D | G339D | G339D | G339D | G339D | G339D |
| R346 | R346K | | | | | | | | R346K | |
| S371 | | | S371F | | S371F | | S371F | S371L | | |
| S373 | | S373P | S373P | S373P | S373P | | S373P | | | S373P |
| S375 | | | S375F | | S375F | | S375F | | | |
| T376 | T376A | T376A | T376A | T376A | T376A | T376A | T376A | | T376A | T376A |
| D405 | D405N | D405N | D405N | D405N | D405N | D405N | D405N | | D405N | D405N |
| R408 | R408S | R408S | R408S | R408S | R408S | R408S | R408S | | R408S | R408S |
| K417 | K417N | K417N | K417N | K417N | K417N | K417N | K417N | K417N | K417N | K417N |
| N440 | N440K | N440K | N440K | N440K | N440K | N440K | N440K | N440K | N440K | N440K |
| G446 | | | | | | | | G446S | G446S | |
| L452 | L452R | | | L452R | L452R | | | | L452R | |
| S477 | S477N | S477N | S477N | S477N | S477N | S477N | S477N | S477N | S477N | S477N |
| T478 | T478K | T478K | T478K | T478K | T478K | T478K | T478K | T478K | T478K | T478K |
| E484 | E484A | E484A | E484A | E484K | E484K | E484A | E484A | E484A | E484K | E484A |
| Q493 | Q493R | Q493R | Q493R | Q493R | Q493R | | Q493R | Q493R | Q493R | Q493R |
| G496 | | | | | | | | G496S | G496S | |
| Q498 | Q498R | Q498R | Q498R | Q498R | | | Q498R | Q498R | Q498R | Q498R |
| N501 | N501Y | N501Y | N501Y | N501Y | N501Y | N501Y | N501Y | N501Y | N501Y | N501Y |
| Y505 | Y505H | Y505H | Y505H | Y505H | | | Y505H | Y505H | Y505H | Y505H |

Figure 6:
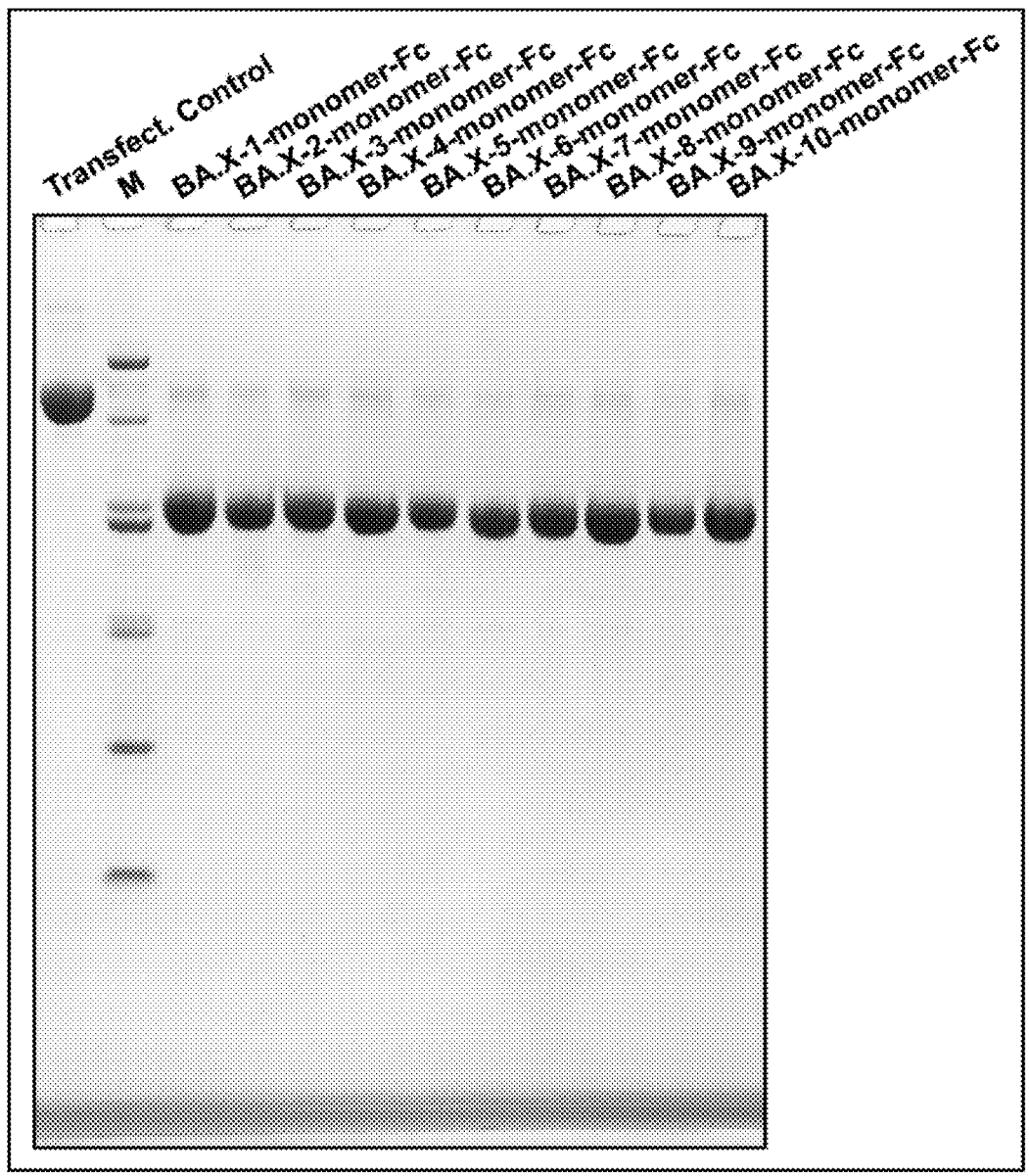
FIG. 6 is an image showing CHO cell expression of BA.X-1-monomer-Fc-BA.X-10-monomer-Fc after 4 days. Protein was affinity purified using Protein A agarose from equal volumes of transfected culture. Eluted protein was loaded based on volume, separated by reducing SDS-PAGE, and detected by Coomassie R-250 staining. M-Molecular weight markers. 'Transfect. Control' is an ACE2-Fc transfection, expression control.

Table 4 (above) depicts the amino acid substitutions, and corresponding positions thereof, within immunogenic fragments BA.X-1-BA.X-10 (SEQ ID NOs: 245-254) in comparison to the Wuhan wild-type variant. Table 5 (below) depicts the amino acid substitutions, and corresponding positions thereof, within the listed natural SARS-CoV-2 variants. As revealed by comparison of Tables 4 and 5, the BA.X-1-BA.X-10 immunogenic fragments each contain a combination of mutations not present in any shown natural SARS-CoV-2 strain. The exemplary particular combination of mutations selected for each BA.X-1-BA.X-10 immunogenic fragment provides broad antigenic coverage over existing SARS-CoV-2 Spike protein variants. Without being bound to any theory, it is expected that the broad antigenic coverage should also provide full or partial protection against later-arising SARS-CoV-2 Spike protein variants as well. The constructs containing the BA.X-1-BA.X-10 immunogenic fragments are capable of being expressed at levels suitable for commercial vaccine production. See Table 3, FIG. 6.

TABLE 5

Natural variant mutations in comparison to Wuhan wild-type variant

| Mutation Position | Alpha | Beta | Gamma | Delta | Delta Plus | Mu | Omicron B.1.1.529 | Omicron BA.2 |
|---|---|---|---|---|---|---|---|---|
| G339 | | | | | | | G339D | G339D |
| R346 | | | | | | R346K | | |
| S371 | | | | | | | S371L | S371F |
| S373 | | | | | | | S373P | S373P |
| S375 | | | | | | | S375F | S375F |
| T376 | | | | | | | | T376A |
| D405 | | | | | | | | D405N |
| R408 | | | | | | | | R408S |
| K417 | | K417N | K417T | | K417N | | K417N | K417N |
| N440 | | | | | | | N440K | N440K |
| G446 | | | | | | | G446S | |
| L452 | | | | L452R | L452R | | | |
| S477 | | | | | | | S477N | S477N |
| T478 | | | | T478K | T478K | | T478K | T478K |
| E484 | | E484K | E484K | | | E484K | E484A | E484A |
| Q493 | | | | | | | Q493R | Q493R |
| G496 | | | | | | | G496S | |
| Q498 | | | | | | | Q498R | Q498R |
| N501 | N501Y | N501Y | N501Y | | | N501Y | N501Y | N501Y |
| Y505 | | | | | | | Y505H | Y505H |

While the invention has been illustrated and described in detail in the drawings and foregoing description, such illustration and description are to be considered illustrative or exemplary and not restrictive. It will be understood that changes and modifications may be made by those of ordinary skill within the scope of the following claims. In particular, the present invention covers further embodiments with any combination of features from different embodiments described above and below. Additionally, statements made herein characterizing the invention refer to an embodiment of the invention and not necessarily all embodiments.

The terms used in the claims should be construed to have the broadest reasonable interpretation consistent with the foregoing description. For example, the use of the article "a" or "the" in introducing an element should not be interpreted as being exclusive of a plurality of elements. Likewise, the recitation of "or" should be interpreted as being inclusive, such that the recitation of "A or B" is not exclusive of "A and B," unless it is clear from the context or the foregoing description that only one of A and B is intended. Further, the recitation of "at least one of A, B and C" should be interpreted as one or more of a group of elements consisting of A, B and C, and should not be interpreted as requiring at least one of each of the listed elements A, B and C, regardless of whether A, B and C are related as categories or otherwise. Moreover, the recitation of "A, B and/or C" or "at least one of A, B or C" should be interpreted as including any singular entity from the listed elements, e.g., A, any subset from the listed elements, e.g., A and B, or the entire list of elements A, B and C.

SEQUENCE LISTING (324 sequences)

SEQ ID NO: 1 - protein, 337 aa, Artificial Sequence
  CTD_long_a
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYST

SEQ ID NO: 2 - DNA, 1011 bp, Artificial Sequence
  CTD_long_a
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctacc

SEQ ID NO: 3 - protein, 337 aa, Artificial Sequence
  CTD_long_a_D614G
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYST

SEQ ID NO: 4 - DNA, 1011 bp, Artificial Sequence
  CTD_long_a_D614G
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaaggtgtcaattgcaccgaggtgcctgtggcaatacatgctgaccagctcaccccaacctggcgagtgtactctacc

SEQ ID NO: 5 - protein, 684 aa, Artificial Sequence
  CTD_long_a-dimer
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGGGGSGGGGSTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYST

SEQ ID NO: 6 - DNA, 2052 bp, Artificial Sequence
  CTD_long_a-dimer
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggtggcggtggctccgggggcggaggttccaccctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctacc

SEQ ID NO: 7 - protein, 329 aa, Artificial Sequence
  CTD_long_b
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYST

SEQ ID NO: 8 - DNA, 987 bp, Artificial Sequence
  CTD_long_b
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctacc

SEQ ID NO: 9 - protein, 325 aa, Artificial Sequence
  CTD_long_c
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWR

SEQ ID NO: 10 - DNA, 975 bp, Artificial Sequence
  CTD_long_c
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcga

SEQ ID NO: 11 - protein, 310 aa, Artificial Sequence
  CTD_long_d
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTE

SEQ ID NO: 12 - DNA, 930 bp, Artificial Sequence
  CTD_long_d
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgag

SEQ ID NO: 13 - protein, 298 aa, Artificial Sequence
  CTD_long_e
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQ

SEQ ID NO: 14 - DNA, 894 bp, Artificial Sequence
  CTD_long_e
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccag

SEQ ID NO: 15 - protein, 293 aa, Artificial Sequence
  CTD_long_f
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGT

SEQ ID NO: 16 - DNA, 879 bp, Artificial Sequence
  CTD_long_f
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcaca

SEQ ID NO: 17 - protein, 315 aa, Artificial Sequence
  CTD_long_g
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTE

SEQ ID NO: 18 - DNA, 945 bp, Artificial Sequence
  CTD_long_g
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgag

SEQ ID NO: 19 - protein, 303 aa, Artificial Sequence
  CTD_long_h
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQ

SEQ ID NO: 20 - DNA, 909 bp, Artificial Sequence
  CTD_long_h
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccag

SEQ ID NO: 21 - protein, 298 aa, Artificial Sequence
  CTD_long_i
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGT

SEQ ID NO: 22 - DNA, 894 bp, Artificial Sequence
  CTD_long_i
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcaca

SEQ ID NO: 23 - protein, 273 aa, Artificial Sequence
  CTD_short_a
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCS

SEQ ID NO: 24 - DNA, 819 bp, Artificial Sequence
  CTD_short_a
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagt

SEQ ID NO: 25 - protein, 261 aa, Artificial Sequence
  CTD_short_b
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCS

SEQ ID NO: 26 - DNA, 783 bp, Artificial Sequence
  CTD_short_b
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagt

SEQ ID NO: 27 - protein, 248 aa, Artificial Sequence
  CTD_short_c
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRD

SEQ ID NO: 28 - DNA, 744 bp, Artificial Sequence
  CTD_short_c
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagat

SEQ ID NO: 29 - protein, 238 aa, Artificial Sequence
  CTD_short_d
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRD

SEQ ID NO: 30 - DNA, 714 bp, Artificial Sequence
  CTD_short_d
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagat

SEQ ID NO: 31 - protein, 225 aa, Artificial Sequence
  CTD_short_e
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTES

SEQ ID NO: 32 - DNA, 675 bp, Artificial Sequence
  CTD_short_e
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatct

SEQ ID NO: 33 - protein, 260 aa, Artificial Sequence
  CTD_short_f
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRD

SEQ ID NO: 34 - DNA, 780 bp, Artificial Sequence
  CTD_short_f
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagat

SEQ ID NO: 35 - protein, 250 aa, Artificial Sequence
  CTD_short_g
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRD

SEQ ID NO: 36 - DNA, 750 bp, Artificial Sequence
  CTD_short_g
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagat

SEQ ID NO: 37 - protein, 237 aa, Artificial Sequence
  CTD_short_h
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTES

SEQ ID NO: 38 - DNA, 711 bp, Artificial Sequence
  CTD_short_h
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatct

SEQ ID NO: 39 - protein, 207 aa, Artificial Sequence
  CTD_short_i
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 40 - DNA, 621 bp, Artificial Sequence
  CTD_short_i
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 41 - protein, 160 aa, Artificial Sequence
  CTD_veryshort_a
SASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKS

SEQ ID NO: 42 - DNA, 480 bp, Artificial Sequence
  CTD_veryshort_a
tccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtcc

SEQ ID NO: 43 - protein, 156 aa, Artificial Sequence
  CTD_veryshort_b
STFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKS

SEQ ID NO: 44 - DNA, 468 bp, Artificial Sequence
  CTD_veryshort_b
agtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtcc

SEQ ID NO: 45 - protein, 156 aa, Artificial Sequence
  CTD_veryshort_c
SASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCG

SEQ ID NO: 46 - DNA, 468 bp, Artificial Sequence
  CTD_veryshort_c
tccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggt

SEQ ID NO: 47 - protein, 167 aa, Artificial Sequence
  CTD_veryshort_d
DYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKS

SEQ ID NO: 48 - DNA, 501 bp, Artificial Sequence
  CTD_veryshort_d
gactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtcc

SEQ ID NO: 49 - protein, 163 aa, Artificial Sequence
  CTD_veryshort_e
DYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCG

SEQ ID NO: 50 - DNA, 489 bp, Artificial Sequence
  CTD_veryshort_e
gactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggt

SEQ ID NO: 51 - protein, 70 aa, Artificial Sequence
  RBD_a
NSNNLDSKVGGNYNYLYRLFRKSNLKPFERDISTEIYQAGSTPCNGVEGFNCYFPLQSYGFQPTNGVGYQ

SEQ ID NO: 52 - DNA, 210 bp, Artificial Sequence
  RBD_a
aattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaa

SEQ ID NO: 53 - protein, 122 aa, Artificial Sequence
  RBD_b
TKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQ

SEQ ID NO: 54 - DNA, 366 bp, Artificial Sequence
  RBD_b
accaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaa

SEQ ID NO: 55 - protein, 80 aa, Artificial Sequence
  RBD_c
NSNNLDSKVGGNYNYLYRLFRKSNLKPFERDISTEIYQAGSTPCNGVEGFNCYFPLQSYGFQPTNGVGYQPYRVVVLSFE

SEQ ID NO: 56 - DNA, 240 bp, Artificial Sequence
  RBD_c
aattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaa

SEQ ID NO: 57 - protein, 58 aa, Artificial Sequence
  RBD_d
GVSPTKLNDLCFTNVYADSFVIRGDEVRQIAPGQTGKIADYNYKLPDDFTGCVIAWNS

SEQ ID NO: 58 - DNA, 174 bp, Artificial Sequence
  RBD_d
ggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattca

SEQ ID NO: 59 - protein, 76 aa, Artificial Sequence
  RBD_e
IAWNSNNLDSKVGGNYNYLYRLFRKSNLKPFERDISTEIYQAGSTPCNGVEGFNCYFPLQSYGFQPTNGVGYQPYR

SEQ ID NO: 60 - DNA, 228 bp, Artificial Sequence
  RBD_e
atcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctataga

SEQ ID NO: 61 - protein, 294 aa, Artificial Sequence
  NTD_long_a
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVE

SEQ ID NO: 62 - DNA, 882 bp, Artificial Sequence
  NTD_long_a
gtgaatcttactacacgtacacagctgccaccagcctataccaacagttttactcgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcagagactaagtgtaccctcaagtctttcactgtggag

SEQ ID NO: 63 - protein, 264 aa, Artificial Sequence
  NTD_short_a
RGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLS

SEQ ID NO: 64 - DNA, 792 bp, Artificial Sequence
  NTD_short_a
cgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctca

SEQ ID NO: 65 - protein, 13 aa, Artificial Sequence
  Fc1
GSGGGGDGGGGSG

SEQ ID NO: 66 - DNA, 39 bp, Artificial Sequence
  Fc1
ggatccggcggcggcggtgacggtggtggcggctccgga

SEQ ID NO: 67 - protein, 19 aa, Artificial Sequence
  Fc1-TEV
GSGGGGENLYFQGGGGGSG

SEQ ID NO: 68 - DNA, 57 bp, Artificial Sequence
  Fc1-TEV
ggatccggcggcggcggtgagaacctgtacttccaaggaggtggtggcggctccgga

SEQ ID NO: 69 - protein, 20 aa, Artificial Sequence
  Fc1-Rv3C
GSGGGGLEVLFQGPGGGGSG

SEQ ID NO: 70 - DNA, 60 bp, Artificial Sequence
  Fc1-Rv3C
ggatccggcggcggcggtctggaggtgctgttccagggacccggtggtggcggctccgga

SEQ ID NO: 71 - protein, 227 aa, Artificial Sequence
  Human IgG1
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 72 - DNA, 684 bp, Artificial Sequence
  Human IgG1
gacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 73 - protein, 515 aa, Artificial Sequence
  LS2330 [CTD_short_a-Fc]
GTRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 74 - DNA, 1557 bp, Artificial Sequence
  LS2330 [CTD_short_a-Fc]
ggtaccagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagtggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 75 - protein, 579 aa, Artificial Sequence
  LS3472, LS3473, LS3474 [CTD_long_a-Fc]
GTTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 76 - DNA, 1749 bp, Artificial Sequence
  LS3472, LS3473, LS3474 [CTD_long_a-Fc]
ggtaccaccctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 77 - protein, 522 aa, Artificial Sequence
  LS3477 [CTD_short_a-TEV-Fc]
MGTRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSGSGGGGENLYFQGGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 78 - DNA, 1578 bp, Artificial Sequence
  LS3477 [CTD_short_a-TEV-Fc]
atgggtaccagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagtggatccggcggcggcggtgagaacctgtacttccaaggaggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 79 - protein, 585 aa, Artificial Sequence
  LS3485 [CTD_long_a-TEV-Fc]
GTTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSGGGGENLYFQGGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 80 - DNA, 1770 bp, Artificial Sequence
  LS3485 [CTD_long_a-TEV-Fc]
atgggtaccaccctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggatccggcggcggcggtgagaacctgtacttccaaggaggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 81 - protein, 523 aa, Artificial Sequence
  LS3489 [CTD_short_a-Rv3c-Fc]
MGTRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSGSGGGGLEVLFQGPGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 82 - DNA, 1581 bp, Artificial Sequence
  LS3489 [CTD_short_a-Rv3c-Fc]
atgggtaccagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagtggatccggcggcggcggtctggaggtgctgttccagggacccggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 83 - protein, 587 aa, Artificial Sequence
  LS3497 [CTD_long_a-Rv3c-Fc]
MGTTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSGGGGLEVLFQGPGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 84 - DNA, 1773 bp, Artificial Sequence
  LS3497 [CTD_long_a-Rv3c-Fc]
atgggtaccaccctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggatccggcggcggcggtctggaggtgctgttccagggacccggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 85 - protein, 358 aa, Artificial Sequence
  LS2316, LS2317, LS2318, LS2319 [CTD_long_a-His
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSSGGGGSGGGGSHHHHHHHH

SEQ ID NO: 86 - DNA, 1086 bp, Artificial Sequence
  LS2316, LS2317, LS2318, LS2319 [CTD_long_a-His
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggaagtagtggaggtggaggcagtggaggcggaggtagtcatcatcatcaccaccaccatcactgataactcgag

SEQ ID NO: 87 - protein, 513 aa, Artificial Sequence
  LS3479 [NTD_short_a-TEV-Fc]
MGTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSGSGGGGENLYFQGGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 88 - DNA, 1551 bp, Artificial Sequence
  LS3479 [NTD_short_a-TEV-Fc]
atgggtacccgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcaggatccggcggcggcggtgagaacctgtacttccaaggaggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 89 - protein, 543 aa, Artificial Sequence
  LS3475 [NTD_long_a-TEV-Fc]
MGTVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEGSGGGGENLYFQGGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 90 - DNA, 1641 bp, Artificial Sequence
  LS3475 [NTD_long_a-TEV-Fc]
atgggtaccgtgaatcttactacacgtacacagctgccaccagcctataccaacagttttactcgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcagagactaagtgtaccctcaagtctttcactgtggagggatccggcggcggcggtgagaacctgtacttccaaggaggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 91 - protein, 514 aa, Artificial Sequence
  LS3491 [NTD_short_a-Rv3c-Fc]
MGTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSGSGGGGLEVLFQGPGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 92 - DNA, 1554 bp, Artificial Sequence
  LS3491 [NTD_short_a-Rv3c-Fc]
atgggtacccgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcaggatccggcggcggcggtctggaggtgctgttccagggacccggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 93 - protein, 544 aa, Artificial Sequence
  LS3487 [NTD_long_a-Rv3C-Fc]
MGTVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEGSGGGGLEVLFQGPGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 94 - DNA, 1644 bp, Artificial Sequence
  LS3487 [NTD_long_a-Rv3C-Fc]
atgggtaccgtgaatcttactacacgtacacagctgccaccagcctataccaacagttttactcgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcagagactaagtgtaccctcaagtctttcactgtggagggatccggcggcggcggtctggaggtgctgttccagggacccggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 95 - protein, 537 aa, Artificial Sequence
  LS2326 [NTD_long_a-Fc]
MGTVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 96 - DNA, 1623 bp, Artificial Sequence
  LS2326 [NTD_long_a-Fc]
atgggtaccgtgaatcttactacacgtacacagctgccaccagcctataccaacagttttactcgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcagagactaagtgtaccctcaagtctttcactgtggagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttgataactcgag

SEQ ID NO: 97 - protein, 577 aa, Artificial Sequence
  LS2354 [CTD_long_a_D614G-Fc]
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 98 - DNA, 1734 bp, Artificial Sequence
  LS2354 [CTD_long_a_D614G-Fc]
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaaggtgtcaattgcaccgaggtgcctgtggcaatacatgctgaccagctcaccccaacctggcgagtgtactctaccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 99 - protein, 924 aa, Artificial Sequence
  LS2355 [CTD_long_a-dimer-Fc]
TLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGGGGSGGGGSTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 100 - DNA, 2775 bp, Artificial Sequence
  LS2355 [CTD_long_a-dimer-Fc]
accctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggtggcggtggctccgggggcggaggttccaccctcaagtctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 101 - protein, 569 aa, Artificial Sequence
  LS2356 [CTD_long_b-Fc]
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 102 - DNA, 1710 bp, Artificial Sequence
  LS2356 [CTD_long_b-Fc]
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgagtgtactctaccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 103 - protein, 565 aa, Artificial Sequence
  LS2357 [CTD_long_c-Fc]
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 104 - DNA, 1698 bp, Artificial Sequence
  LS2357 [CTD_long_c-Fc]
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgaggtgcctgtggcaatacatgctgaccagctcaccccaacctggcgaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 105 - protein, 550 aa, Artificial Sequence
  LS2358 [CTD_long_d-Fc]
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 106 - DNA, 1653 bp, Artificial Sequence
  LS2358 [CTD_long_d-Fc]
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 107 - protein, 538 aa, Artificial Sequence
  LS2359 [CTD_long_e-Fc]
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 108 - DNA, 1617 bp, Artificial Sequence
  LS2359 [CTD_long_e-Fc]
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 109 - protein, 533 aa, Artificial Sequence
  LS2360 [CTD_long_f-Fc]
KGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 110 - DNA, 1602 bp, Artificial Sequence
  LS2360 [CTD_long_f-Fc]
aaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 111 - protein, 555 aa, Artificial Sequence
  LS2361 [CTD_long_g-Fc]
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 112 - DNA, 1668 bp, Artificial Sequence
  LS2361 [CTD_long_g-Fc]
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccaggtggctgtgctgtatcaagatgtcaattgcaccgagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 113 - protein, 543 aa, Artificial Sequence
  LS2362 [CTD_long_h-Fc]
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 114 - DNA, 1632 bp, Artificial Sequence
  LS2362 [CTD_long_h-Fc]
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaaacacctcaaaccagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 115 - protein, 538 aa, Artificial Sequence
  LS2363 [CTD_long_i-Fc]
SFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 116 - DNA, 1617 bp, Artificial Sequence
  LS2363 [CTD_long_i-Fc]
tctttcactgtggagaaagggatctatcaaaccagcaattttagggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagttttggaggcgtgtctgtgatcacccctggcacaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 117 - protein, 501 aa, Artificial Sequence
  LS2364 [CTD_short_b-Fc]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 118 - DNA, 1506 bp, Artificial Sequence
  LS2364 [CTD_short_b-Fc]
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatccccagactcttgagatccttgacatcaccccatgcagtggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 119 - protein, 488 aa, Artificial Sequence
  LS2365 [CTD_short_c-Fc]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 120 - DNA, 1467 bp, Artificial Sequence
  LS2365 [CTD_short_c-Fc]
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 121 - protein, 478 aa, Artificial Sequence
  LS2366 [CTD_short_d-Fc]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 122 - DNA, 1437 bp, Artificial Sequence
  LS2366 [CTD_short_d-Fc]
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 123 - protein, 465 aa, Artificial Sequence
  LS2367 [CTD_short_e-Fc]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 124 - DNA, 1398 bp, Artificial Sequence
  LS2367 [CTD_short_e-Fc]
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 125 - protein, 500 aa, Artificial Sequence
  LS2368 [CTD_short_f-Fc]
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 126 - DNA, 1503 bp, Artificial Sequence
  LS2368 [CTD_short_f-Fc]
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatatcgctgacacaaccgacgccgtaagagatggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 127 - protein, 490 aa, Artificial Sequence
  LS2369 [CTD_short_g-Fc]
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 128 - DNA, 1473 bp, Artificial Sequence
  LS2369 [CTD_short_g-Fc]
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctaacaaaaaattccttcccttccagcaattcgggagagatggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 129 - protein, 477 aa, Artificial Sequence
  LS2370 [CTD_short_h-Fc]
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 130 - DNA, 1434 bp, Artificial Sequence
  LS2370 [CTD_short_h-Fc]
agggttcagcccaccgaatcaatagtacggttcccaaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaatgcgtgaacttcaatttcaatggcctcaccggaacaggtgttttgacagaatctggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 131 - protein, 447 aa, Artificial Sequence
  LS2371 [CTD_short_i-Fc]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 132 - DNA, 1344 bp, Artificial Sequence
  LS2371 [CTD_short_i-Fc]
aatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 133 - protein, 400 aa, Artificial Sequence
  LS2372 [CTD_veryshort_a-Fc]
SASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 134 - DNA, 1203 bp, Artificial Sequence
  LS2372 [CTD_veryshort_a-Fc]
tccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 135 - protein, 396 aa, Artificial Sequence
  LS2373 [CTD_veryshort_b-Fc]
STFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 136 - DNA, 1191 bp, Artificial Sequence
  LS2373 [CTD_veryshort_b-Fc]
agtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 137 - protein, 396 aa, Artificial Sequence
  LS2374 [CTD_veryshort_c-Fc]
SASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 138 - DNA, 1191 bp, Artificial Sequence
  LS2374 [CTD_veryshort_c-Fc]
tccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 139 - protein, 407 aa, Artificial Sequence
  LS2375 [CTD_veryshort_d-Fc]
DYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 140 - DNA, 1224 bp, Artificial Sequence
  LS2375 [CTD_veryshort_d-Fc]
gactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 141 - protein, 403 aa, Artificial Sequence
  LS2376 [CTD_veryshort_e-Fc]
DYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 142 - DNA, 1212 bp, Artificial Sequence
  LS2376 [CTD_veryshort_e-Fc]
gactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 143 - protein, 310 aa, Artificial Sequence
  LS2377 [RBD_a-Fc]
NSNNLDSKVGGNYNYLYRLFRKSNLKPFERDISTEIYQAGSTPCNGVEGFNCYFPLQSYGFQPTNGVGYQGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 144 - DNA, 933 bp, Artificial Sequence
  LS2377 [RBD_a-Fc]
aattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 145 - protein, 362 aa, Artificial Sequence
  LS2378 [RBD_b-Fc]
TKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 146 - DNA, 1089 bp, Artificial Sequence
  LS2378 [RBD_b-Fc]
accaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 147 - protein, 320 aa, Artificial Sequence
  LS2379 [RBD_c-Fc]
NSNNLDSKVGGNYNYLYRLFRKSNLKPFERDISTEIYQAGSTPCNGVEGFNCYFPLQSYGFQPTNGVGYQPYRVVVLSFEGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 148 - DNA, 963 bp, Artificial Sequence
  LS2379 [RBD_c-Fc]
aattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 149 - protein, 298 aa, Artificial Sequence
  LS2380 [RBD_d-Fc]
GVSPTKLNDLCFTNVYADSFVIRGDEVRQIAPGQTGKIADYNYKLPDDFTGCVIAWNSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 150 - DNA, 897 bp, Artificial Sequence
  LS2380 [RBD_d-Fc]
ggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 151 - protein, 316 aa, Artificial Sequence
  LS2381 [RBD_e-Fc]
IAWNSNNLDSKVGGNYNYLYRLFRKSNLKPFERDISTEIYQAGSTPCNGVEGFNCYFPLQSYGFQPTNGVGYQPYRGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 152 - DNA, 951 bp, Artificial Sequence
  LS2381 [RBD_e-Fc]
atcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 153 - protein, 504 aa, Artificial Sequence
  LS2382 [NTD_short_a-Fc]
RGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 154 - DNA, 1515 bp, Artificial Sequence
  LS2382 [NTD_short_a-Fc]
cgtggtgtatactaccccgataaggtttttcgctcttccgtgctccatagtacacaggatctcttcctgccattcttcagtaatgtcacctggtttcatgctattcatgtgtctggaactaatggaaccaagcgctttgataatccagtactcccttttaatgacggagtttacttcgcaagcacagaaaagtccaatatcatacgcgggtggattttcggaactaccctcgactccaagactcaatcactccttatagtcaataacgccaccaatgtggtcatcaaagtctgtgaatttcaattttgcaacgacccattcctgggcgtctactatcataaaaacaataagagctggatggaatccgaatttagagtatacagttctgctaataattgcacattcgaatatgtatcccaacccttccttatggatttggagggcaagcaaggcaatttcaaaaacttgcgggaatttgtcttcaaaaacatagatgggtacttcaaaatttatagtaagcatacacctattaacttggttcgagacttgcctcagggcttcagcgcccttgaacctcttgtggatttgccaatcggcatcaatataacacgatttcagacactcttggcactgcatcgttcctacctgactccaggagactctagctctggttggacagcaggcgccgctgcttactatgtcggctacttgcaacctcgaacattccttctcaaatataacgaaaatggaactatcacagatgccgtggattgtgccttggaccctctctcaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 155 - protein, 404 aa, Artificial Sequence
  LS2393 [(RBD-tight)2-Fc]
GDEMGTIAWNSNNLDSKVGGNYNYLYRLFRKSNLKPFERDISTEIYQAGSTPCNGVEGFNCYFPLQSYGFQPTNGVGYQPYRSGGGGSIAWNSNNLDSKVGGNYNYLYRLFRKSNLKPFERDISTEIYQAGSTPCNGVEGFNCYFPLQSYGFQPTNGVGYQPYRGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 156 - DNA, 1215 bp, Artificial Sequence
  LS2393 [(RBD-tight)2-Fc]
ggcgatgagatgggtaccatcgcatggaacagcaacaacctggatagcaaagtgggcggcaactataattacctgtatcgactcttcagaaagagtaatctgaagcctttcgaaagggatatcagtactgaaatatatcaggctggcagtactccttgcaatggagtagagggctttaactgttatttcccacttcagtcatacggttttcagcccaccaacggagtcggctatcagccttacagatcagggggcggaggaagtatcgcatggaactccaataatctcgacagcaaagtcggaggcaattacaattatctgtataggctcttcagaaaaagtaacctcaagccgttcgaacgggatatcagcactgagatataccaagccgggagtacaccctgtaacggagtcgagggctttaactgttacttccctctacagtcctatggctttcagcccaccaatggcgttgggtatcagccttatagaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 157 - protein, 430 aa, Artificial Sequence
  LS2394 [(RBD-extended)2-Fc]
GDEMGTIAWNSNNLDSKVGGNYNYLYRLFRKSNLKPFERDISTEIYQAGSTPCNGVEGFNCYFPLQSYGFQPTNGVGYQPYRVVVLSFELLHAPATGGGSIAWNSNNLDSKVGGNYNYLYRLFRKSNLKPFERDISTEIYQAGSTPCNGVEGFNCYFPLQSYGFQPTNGVGYQPYRVVVLSFELLHAPATGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 158 - DNA, 1293 bp, Artificial Sequence
  LS2394 [(RBD-extended)2-Fc]
ggcgatgagatgggtaccattgcatggaattcaaacaacctggattccaaggtcggtggtaattacaactatctatacagactgttccgaaagagcaacttgaaaccctttgaacgtgatatctccacagaaatttatcaggccggttccaccccttgcaacggcgttgagggttttaactgctattttccgctgcagagctacggttttcagccaactaatggagttggatatcaaccttaccgggtggttgtgctatccttcgaattgctccatgctcctgctaccggtggcggcagcatcgcatggaacagcaataatttggatagtaaagtgggcgggaattataactacctgtaccggctgttcagaaagagcaatctgaaaccttttgagcgggacatttccactgagatctaccaggccggcagcaccccctgtaacggagtcgaaggattcaattgttacttcccacttcaaagctatggattccaacctacaaatggggtcggctatcaaccatatcgcgttgtggtcttgtcctttgagcttttgcatgcccctgccactggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 159 - protein, 404 aa, Artificial Sequence; identical to SEQ ID NO: 155
  LS2395 [(RBD)2-Fc]

SEQ ID NO: 160 - DNA, 1215 bp, Artificial Sequence
  LS2395 [(RBD)2-Fc]
ggcgatgagatgggtaccatcgcttggaactccaacaatctggactccaaagtgggcggaaattacaattatctgtatcgcctcttccgtaagtctaacctcaagccttttgagagagacatctccactgagatatatcaggccggatcaactccctgtaacggtgtagaagggttcaattgctatttcccactgcagagttacggttttcagcccactaatggcgttggataccaaccctacaggtcaggaggcgggggatctattgcctggaactcaaataatctcgattctaaggttggcggtaactataattatctctatcggctgttccgcaaatccaaccttaaaccctttgagcgtgatataagtactgagatttaccaagcagggagcaccccctgcaatggcgtggaagggttcaactgctacttccccctccaaagctatggatttcagccaactaacggcgttggttaccagccctatagaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 161 - protein, 734 aa, Artificial Sequence
  LS2397-2400 [(CTD_short_d)2-Fc]
GDEMGTNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 162 - DNA, 2205 bp, Artificial Sequence
  LS2397-2400 [(CTD_short_d)2-Fc]
ggcgatgagatgggtaccaatataaccaacttgtgcccatttggagaagtatttaatgccacaaggttcgcttccgtttatgcatggaaccgcaagcgaatttccaattgcgtggccgattactccgtactgtacaattccgctagcttctctactttcaaatgctatggcgtgtcacctactaagctcaatgatctgtgcttcacaaatgtttatgcagattcattcgttatcaggggggacgaggtgagacagatagctcccgggcaaacaggcaagattgccgactacaattataagctgccagatgattttaccggttgcgttatagcatggaattccaacaacctggacagcaaagtaggaggtaattacaattatctctatcgtctgtttaggaagagcaacctcaagcctttcgaacgggacatatcaacagagatatatcaagcaggttccactccctgtaacggcgttgagggatttaattgttatttcccactccaaagctatggttttcagccaactaacggcgtaggttaccaaccataccgtgtcgtcgttctgagtttcgagcttctccatgcccctgctaccgtatgtggtcccaaaaaatctaccaatctggttaaaaacaagtgtgtaaactttaactttaacgggctgaccggtactggggtactgactgagtctaataagaagttcctcccatttcagcaattcgggcgcgatggctccggtggcgggggaagcggcgggggtggcagtaatatcactaatctgtgcccctttggagaagtgttcaacgctacacggtttgcctccgtgtatgcatggaaccgaaaacgcatttctaattgcgtcgccgattatagtgtgttgtataatagcgcatccttctccacttttaaatgttacggagttagcccaaccaaactcaatgacctctgctttacaaacgtatatgccgatagttttgtaattaggggagatgaagtcagacaaatcgccccagggcaaactggaaaaatcgctgattacaactacaagctccctgacgattttacagggtgtgtgatagcttggaactctaacaacctcgacagtaaggtcggtggaaattataactatctgtaccgattgtttcgtaagtcaaacctgaaaccattcgaacgggatatttccactgagatttatcaggctggcagtacaccttgtaacggggtagagggattcaattgctactttccacttcagtcttacgggttccagcctacaaacggtgttggttaccagccctacagagttgtagttttgtcctttgaattgctccatgcccctgccaccgtctgtggacccaaaaaatcaactaaccttgtcaagaataagtgcgtgaacttcaacttcaatggtctcaccggcaccggggtacttacagagagtaacaaaaagttccttcccttccagcagtttgggcgagacggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 163 - protein, 672 aa, Artificial Sequence
  LS2401-2404 [(CTD_short_i)2-Fc]
GDEMGTNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 164 - DNA, 2019 bp, Artificial Sequence
  LS2401-2404 [(CTD_short_i)2-Fc]
ggcgatgagatgggtaccaatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaagatcgctgactacaattacaagcttccagatgacttcactgggtgcgtaatcgcctggaacagtaacaacttggactctaaagtcggagggaattataattacctttatcgtctcttccgcaaaagtaacttgaagccttttgagagggacatttccacagagatatatcaagcaggttccacaccatgcaacggcgtcgagggatttaattgttatttccccctccaatcatacggctttcagccaactaacggcgttggctaccaaccatacagagtcgtagtgctttcctttgaactgctgcacgcccctgccactgtgtgtggcccaaaaaagagcaccaatttggtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 165 - protein, 672 aa, Artificial Sequence
  LS2421 and LS2422 [(CTD_short_i)2-Fc; D2 mutations for 501.V2 variant, K417N, E484K, N501Y]
GDEMGTNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 166 - DNA, 2019 bp, Artificial Sequence
  LS2421 and LS2422 [(CTD_short_i)2-Fc; D2 mutations for 501.V2 variant, K417N, E484K, N501Y]
ggcgatgagatgggtaccaatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaacatcgctgactacaattacaagcttccagatgacttcactgggtgcgtaatcgcctggaacagtaacaacttggactctaaagtcggagggaattataattacctttatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 167 - protein, 672 aa, Artificial Sequence
  LS2423 [(CTD_short_i)2-Fc; D2 mutations for hybrid P.1 and CAL.20C variants; K417T, L452R, E484K, N501Y]
GDEMGTNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 168 - DNA, 2019 bp, Artificial Sequence
  LS2423 [(CTD_short_i)2-Fc; D2 mutations for hybrid P.1 and CAL.20C variants; K417T, L452R, E484K, N501Y]
ggcgatgagatgggtaccaatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaccatcgctgactacaattacaagcttccagatgacttcactgggtgcgtaatcgcctggaacagtaacaacttggactctaaagtcggagggaattataattaccggtatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 169 - protein, 672 aa, Artificial Sequence
  LS2435 [(CTD_short_i)2-Fc; D1 and D2 mutations for hybrid P.1 and CAL.20C variants; K417T, L452R, E484K, N501Y]
GDEMGTNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 170 - DNA, 2019 bp, Artificial Sequence
  LS2435 [(CTD_short_i)2-Fc; D1 and D2 mutations for hybrid P.1 and CAL.20C variants; K417T, L452R, E484K, N501Y]
ggcgatgagatgggtaccaatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaccatcgctgactacaattacaaacttcctgatgacttcactggttgtgtgattgcttggaattccaacaatctggattccaaagtgggtgggaattacaattacagatatagattgtttagaaaatctaacctcaagccattcgaacgggatataagcacagaaatctatcaggctgggagcacaccttgtaacggcgtaaaggggttcaattgctattttccacttcagtcatacggctttcaacccacctatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaccatcgctgactacaattacaagcttccagatgacttcactgggtgcgtaatcgcctggaacagtaacaacttggactctaaagtcggagggaattataattaccggtatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 171 - protein, 76 aa, Artificial Sequence; identical to SEQ ID NO: 59
  RBD-tight

SEQ ID NO: 172 - DNA, 228 bp, Artificial Sequence
  RBD-tight
atcgcatggaacagcaacaacctggatagcaaagtgggcggcaactataattacctgtatcgactcttcagaaagagtaatctgaagcctttcgaaagggatatcagtactgaaatatatcaggctggcagtactccttgcaatggagtagagggctttaactgttatttcccacttcagtcatacggttttcagcccaccaacggagtcggctatcagccttacaga

SEQ ID NO: 173 - protein, 158 aa, Artificial Sequence
  (RBD-tight)2
IAWNSNNLDSKVGGNYNYLYRLFRKSNLKPFERDISTEIYQAGSTPCNGVEGFNCYFPLQSYGFQPTNGVGYQPYRSGGGGSIAWNSNNLDSKVGGNYNYLYRLFRKSNLKPFERDISTEIYQAGSTPCNGVEGFNCYFPLQSYGFQPTNGVGYQPYR

SEQ ID NO: 174 - DNA, 474 bp, Artificial Sequence
  (RBD-tight)2
atcgcatggaacagcaacaacctggatagcaaagtgggcggcaactataattacctgtatcgactcttcagaaagagtaatctgaagcctttcgaaagggatatcagtactgaaatatatcaggctggcagtactccttgcaatggagtagagggctttaactgttatttcccacttcagtcatacggttttcagcccaccaacggagtcggctatcagccttacagatcagggggcggaggaagtatcgcatggaactccaataatctcgacagcaaagtcggaggcaattacaattatctgtataggctcttcagaaaaagtaacctcaagccgttcgaacgggatatcagcactgagatataccaagccgggagtacaccctgtaacggagtcgagggctttaactgttacttccctctacagtcctatggctttcagcccaccaatggcgttgggtatcagccttataga

SEQ ID NO: 175 - protein, 90 aa, Artificial Sequence
  RBD-extended
IAWNSNNLDSKVGGNYNYLYRLFRKSNLKPFERDISTEIYQAGSTPCNGVEGFNCYFPLQSYGFQPTNGVGYQPYRVVVLSFELLHAPAT

SEQ ID NO: 176 - DNA, 270 bp, Artificial Sequence
  RBD-extended
attgcatggaattcaaacaacctggattccaaggtcggtggtaattacaactatctatacagactgttccgaaagagcaacttgaaaccctttgaacgtgatatctccacagaaatttatcaggccggttccaccccttgcaacggcgttgagggttttaactgctattttccgctgcagagctacggttttcagccaactaatggagttggatatcaaccttaccgggtggttgtgctatccttcgaattgctccatgctcctgctacc

SEQ ID NO: 177 - protein, 184 aa, Artificial Sequence
  (RBD-extended)2
IAWNSNNLDSKVGGNYNYLYRLFRKSNLKPFERDISTEIYQAGSTPCNGVEGFNCYFPLQSYGFQPTNGVGYQPYRVVVLSFELLHAPATGGGSIAWNSNNLDSKVGGNYNYLYRLFRKSNLKPFERDISTEIYQAGSTPCNGVEGFNCYFPLQSYGFQPTNGVGYQPYRVVVLSFELLHAPAT

SEQ ID NO: 178 - DNA, 552 bp, Artificial Sequence
  (RBD-extended)2
attgcatggaattcaaacaacctggattccaaggtcggtggtaattacaactatctatacagactgttccgaaagagcaacttgaaaccctttgaacgtgatatctccacagaaatttatcaggccggttccaccccttgcaacggcgttgagggttttaactgctattttccgctgcagagctacggttttcagccaactaatggagttggatatcaaccttaccgggtggttgtgctatccttcgaattgctccatgctcctgctaccggtggcggcagcatcgcatggaacagcaataatttggatagtaaagtgggcgggaattataactacctgtaccggctgttcagaaagagcaatctgaaaccttttgagcgggacatttccactgagatctaccaggccggcagcaccccctgtaacggagtcgaaggattcaattgttacttcccacttcaaagctatggattccaacctacaaatggggtcggctatcaaccatatcgcgttgtggtcttgtcctttgagcttttgcatgcccctgccact

SEQ ID NO: 179 - protein, 77 aa, Artificial Sequence
  RBD
IAWNSNNLDSKVGGNYNYLYRLFRKSNLKPFERDISTEIYQAGSTPCNGVEGFNCYFPLQSYGFQPTNGVGYQPYRS

SEQ ID NO: 180 - DNA, 231 bp, Artificial Sequence
  RBD
atcgcttggaactccaacaatctggactccaaagtgggcggaaattacaattatctgtatcgcctcttccgtaagtctaacctcaagccttttgagagagacatctccactgagatatatcaggccggatcaactccctgtaacggtgtagaagggttcaattgctatttcccactgcagagttacggttttcagcccactaatggcgttggataccaaccctacaggtca

SEQ ID NO: 181 - protein, 158 aa, Artificial Sequence; identical to SEQ ID NO: 173
  (RBD)2

SEQ ID NO: 182 - DNA, 474 bp, Artificial Sequence
  (RBD)2
atcgcttggaactccaacaatctggactccaaagtgggcggaaattacaattatctgtatcgcctcttccgtaagtctaacctcaagccttttgagagagacatctccactgagatatatcaggccggatcaactccctgtaacggtgtagaagggttcaattgctatttcccactgcagagttacggttttcagcccactaatggcgttggataccaaccctacaggtcaggaggcgggggatctattgcctggaactcaaataatctcgattctaaggttggcggtaactataattatctctatcggctgttccgcaaatccaaccttaaaccctttgagcgtgatataagtactgagatttaccaagcagggagcaccccctgcaatggcgtggaagggttcaactgctacttccccctccaaagctatggatttcagccaactaacggcgttggttaccagccctataga

SEQ ID NO: 183 - protein, 488 aa, Artificial Sequence
  (CTD_short_d)2
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRD

SEQ ID NO: 184 - DNA, 1464 bp, Artificial Sequence
  (CTD_short_d)2
aatataaccaacttgtgcccatttggagaagtatttaatgccacaaggttcgcttccgtttatgcatggaaccgcaagcgaatttccaattgcgtggccgattactccgtactgtacaattccgctagcttctctactttcaaatgctatggcgtgtcacctactaagctcaatgatctgtgcttcacaaatgtttatgcagattcattcgttatcaggggggacgaggtgagacagatagctcccgggcaaacaggcaagattgccgactacaattataagctgccagatgattttaccggttgcgttatagcatggaattccaacaacctggacagcaaagtaggaggtaattacaattatctctatcgtctgtttaggaagagcaacctcaagcctttcgaacgggacatatcaacagagatatatcaagcaggttccactccctgtaacggcgttgagggatttaattgttatttcccactccaaagctatggttttcagccaactaacggcgtaggttaccaaccataccgtgtcgtcgttctgagtttcgagcttctccatgcccctgctaccgtatgtggtcccaaaaaatctaccaatctggttaaaaacaagtgtgtaaactttaactttaacgggctgaccggtactggggtactgactgagtctaataagaagttcctcccatttcagcaattcgggcgcgatggctccggtggcgggggaagcggcgggggtggcagtaatatcactaatctgtgcccctttggagaagtgttcaacgctacacggtttgcctccgtgtatgcatggaaccgaaaacgcatttctaattgcgtcgccgattatagtgtgttgtataatagcgcatccttctccacttttaaatgttacggagttagcccaaccaaactcaatgacctctgctttacaaacgtatatgccgatagttttgtaattaggggagatgaagtcagacaaatcgccccagggcaaactggaaaaatcgctgattacaactacaagctccctgacgattttacagggtgtgtgatagcttggaactctaacaacctcgacagtaaggtcggtggaaattataactatctgtaccgattgtttcgtaagtcaaacctgaaaccattcgaacgggatatttccactgagatttatcaggctggcagtacaccttgtaacggggtagagggattcaattgctactttccacttcagtcttacgggttccagcctacaaacggtgttggttaccagccctacagagttgtagttttgtcctttgaattgctccatgcccctgccaccgtctgtggacccaaaaaatcaactaaccttgtcaagaataagtgcgtgaacttcaacttcaatggtctcaccggcaccggggtacttacagagagtaacaaaaagttccttcccttccagcagtttgggcgagac

SEQ ID NO: 185 - protein, 426 aa, Artificial Sequence
  (CTD_short_i)2
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 186 - DNA, 1278 bp, Artificial Sequence
  (CTD_short_i)2
aatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaagatcgctgactacaattacaagcttccagatgacttcactgggtgcgtaatcgcctggaacagtaacaacttggactctaaagtcggagggaattataattacctttatcgtctcttccgcaaaagtaacttgaagccttttgagagggacatttccacagagatatatcaagcaggttccacaccatgcaacggcgtcgagggatttaattgttatttccccctccaatcatacggctttcagccaactaacggcgttggctaccaaccatacagagtcgtagtgctttcctttgaactgctgcacgcccctgccactgtgtgtggcccaaaaaagagcaccaatttggtaaagaacaag

SEQ ID NO: 187 - protein, 427 aa, Artificial Sequence
  (CTD_short_i)2 [D2 mutations for 501.V2 variant, K417N, E484K, N501Y - mod. 1]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGNNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNK

SEQ ID NO: 188 - DNA, 1278 bp, Artificial Sequence
  (CTD_short_i)2 [D2 mutations for 501.V2 variant, K417N, E484K, N501Y - mod. 1]
aatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaacatcgctgactacaattacaagcttccagatgacttcactgggtgcgtaatcgcctggaacagtaacaacttggactctaaagtcggagggaattataattacctttatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaag

SEQ ID NO: 189 - protein, 426 aa, Artificial Sequence
  (CTD_short_i)2 [D2 mutations for hybrid P.1 and CAL.20C variants; K417T, L452R, E484K, N501Y - mod. 2]
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNK

SEQ ID NO: 190 - DNA, 1278 bp, Artificial Sequence
  (CTD_short_i)2 [D2 mutations for hybrid P.1 and CAL.20C variants; K417T, L452R, E484K, N501Y - mod. 2]
aatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaagatcgctgactacaattacaaacttcctgatgacttcactggttgtgtgattgcttggaattccaacaatctggattccaaagtgggtgggaattacaattacttgtatagattgtttagaaaatctaacctcaagccattcgaacgggatataagcacagaaatctatcaggctgggagcacaccttgtaacggcgtagaggggttcaattgctattttccacttcagtcatacggctttcaacccaccaatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaccatcgctgactacaattacaagcttccagatgacttcactgggtgcgtaatcgcctggaacagtaacaacttggactctaaagtcggagggaattataattaccggtatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaag

SEQ ID NO: 191 - protein, 426 aa, Artificial Sequence
  (CTD_short_i)2 [D1 and D2 mutations for hybrid P.1 and CAL.20C variants; K417T, L452R, E484K, N501Y- mod. 3]
NITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNKGSGGGGSGGGGSNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYRYRLFRKSNLKPFERDISTEIYQAGSTPCNGVKGFNCYFPLQSYGFQPTYGVGYQPYRVVVLSFELLHAPATVCGPKKSTNLVKNK

SEQ ID NO: 192 - DNA, 1278 bp, Artificial Sequence
  (CTD_short_i)2 [D1 and D2 mutations for hybrid P.1 and CAL.20C variants; K417T, L452R, E484K, N501Y- mod. 3]
aatatcacaaacttgtgcccatttggggaggtcttcaatgccactcggtttgcatcagtatatgcatggaatcgtaaacggatatcaaattgcgttgctgactattcagtcctctataatagtgctagtttcagtacatttaaatgctacggagtatctcctactaagttgaatgacctttgcttcacaaatgtctatgctgacagttttgttattaggggtgacgaggtgcggcagattgcacccgggcaaacaggaaccatcgctgactacaattacaaacttcctgatgacttcactggttgtgtgattgcttggaattccaacaatctggattccaaagtgggtgggaattacaattacagatatagattgtttagaaaatctaacctcaagccattcgaacgggatataagcacagaaatctatcaggctgggagcacaccttgtaacggcgtaaaggggttcaattgctattttccacttcagtcatacggctttcaacccacctatggggtgggataccagccatatcgagtggtcgtactctctttcgagctgcttcatgcccccgcaaccgtgtgtggtcccaaaaaaagcaccaatctcgtcaagaataagggatcaggggggggcggatcaggcggtggaggcagcaacataactaatctttgtccattcggtgaagtctttaatgcaacccgttttgcttctgtgtatgcatggaacaggaaaagaatatccaattgcgttgccgactatagcgtcctttacaattctgcctcctttagcacatttaagtgttatggggtctcccccactaagctgaatgatctgtgtttcaccaacgtttatgcagactcctttgttatacggggggatgaagttcgacaaatagcacccgggcagacagggaccatcgctgactacaattacaagcttccagatgacttcactgggtgcgtaatcgcctggaacagtaacaacttggactctaaagtcggagggaattataattaccggtatcgtctcttccgcaaaagtaacttgaagccttttgagagggacatttccacagagatatatcaagcaggttccacaccatgcaacggcgtcaagggatttaattgttatttccccctccaatcatacggctttcagccaacttacggcgttggctaccaaccatacagagtcgtagtgctttcctttgaactgctgcacgcccctgccactgtgtgtggcccaaaaaagagcaccaatttggtaaagaacaag

SEQ ID NO: 193 - protein, 13 aa, Artificial Sequence
  Short
GSGGGGDGGGGSG

SEQ ID NO: 194 - DNA, 39 bp, Artificial Sequence; identical to SEQ ID NO: 66
  Short

SEQ ID NO: 195 - protein, 25 aa, Artificial Sequence
  Medium
GSGGGGDSGGGGSGGGGSSGGGGSG

SEQ ID NO: 196 - DNA, 75 bp, Artificial Sequence
  Medium
ggatccggcggcggcggtgactccgggggaggaggttccggcggcggaggatcgagcggtggtggcggctccgga

SEQ ID NO: 197 - protein, 32 aa, Artificial Sequence
  Long
GSGGGGDSGGGGSGGSGGSGGSGGGSGGGGSG

SEQ ID NO: 198 - DNA, 96 bp, Artificial Sequence
  Long
ggatccggcggcggcggtgactccgggggcggaggttccggtggctctggtggctctggaggctcgggaggcggaagcggtggtggcggctccgga

SEQ ID NO: 199 - protein, 234 aa, Artificial Sequence
  SARS_short_h
RVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLT

SEQ ID NO: 200 - DNA, 702 bp, Artificial Sequence
  SARS_short_h
agggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttact

SEQ ID NO: 201 - protein, 205 aa, Artificial Sequence
  SARS_short_i
NITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKN

SEQ ID NO: 202 - DNA, 615 bp, Artificial Sequence
  SARS_short_i
aacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaat

SEQ ID NO: 203 - protein, 232 aa, Artificial Sequence
  MERS_Lytic_a
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGN

SEQ ID NO: 204 - DNA, 696 bp, Artificial Sequence
  MERS_Lytic_a
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaaatagcctcacagttgggtaat

SEQ ID NO: 205 - protein, 225 aa, Artificial Sequence
  MERS_Lytic_b
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTK

SEQ ID NO: 206 - DNA, 675 bp, Artificial Sequence
  MERS_Lytic_b
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaa

SEQ ID NO: 207 - protein, 214 aa, Artificial Sequence
  MERS_Lytic_c
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLE

SEQ ID NO: 208 - DNA, 642 bp, Artificial Sequence
  MERS_Lytic_c
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaa

SEQ ID NO: 209 - protein, 209 aa, Artificial Sequence
  MERS_Lytic_d
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPK

SEQ ID NO: 210 - DNA, 627 bp, Artificial Sequence
  MERS_Lytic_d
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaa

SEQ ID NO: 211 - protein, 219 aa, Artificial Sequence
  MERS_Lytic_e
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLE

SEQ ID NO: 212 - DNA, 657 bp, Artificial Sequence
  MERS_Lytic_e
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaa

SEQ ID NO: 213 - protein, 220 aa, Artificial Sequence
  MERS_Lytic_f
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTK

SEQ ID NO: 214 - DNA, 660 bp, Artificial Sequence
  MERS_Lytic_f
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaa

SEQ ID NO: 215 - protein, 217 aa, Artificial Sequence
  MERS_Lytic_g
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTK

SEQ ID NO: 216 - DNA, 651 bp, Artificial Sequence
  MERS_Lytic_g
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaa

SEQ ID NO: 217 - protein, 699 aa, Artificial Sequence
  Ma_l1_Sh_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNSGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 218 - DNA, 2097 bp, Artificial Sequence
  Ma_l1_Sh_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaaatagcctcacagttgggtaattctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 219 - protein, 670 aa, Artificial Sequence
  Ma_l1_Si_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNSGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 220 - DNA, 2010 bp, Artificial Sequence
  Ma_l1_Si_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaaatagcctcacagttgggtaattctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 221 - protein, 692 aa, Artificial Sequence
  Mb_l1_Sh_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 222 - DNA, 2076 bp, Artificial Sequence
  Mb_l1_Sh_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 223 - protein, 663 aa, Artificial Sequence
  Mb_l1_Si_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 224 - DNA, 1989 bp, Artificial Sequence
  Mb_l1_Si_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 225 - protein, 681 aa, Artificial Sequence
  Mc_l1_Sh_l2_S2
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLESGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 226 - DNA, 2043 bp, Artificial Sequence
  Mc_l1_Sh_l2_S2
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 227 - protein, 652 aa, Artificial Sequence
  Mc_l1_Si_l2_S2
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLESGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 228 - DNA, 1956 bp, Artificial Sequence
  Mc_l1_Si_l2_S2
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 229 - protein, 676 aa, Artificial Sequence
  Md_l1_Sh_l2_S2
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKSGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 230 - DNA, 2028 bp, Artificial Sequence
  Md_l1_Sh_l2_S2
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 231 - protein, 647 aa, Artificial Sequence
  Md_l1_Si_l2_S2
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKSGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 232 - DNA, 1941 bp, Artificial Sequence
  Md_l1_Si_l2_S2
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 233 - protein, 686 aa, Artificial Sequence
  Me_l1_Sh_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLESGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 234 - DNA, 2058 bp, Artificial Sequence
  Me_l1_Sh_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 235 - protein, 657 aa, Artificial Sequence
  Me_l1_Si_l2_S2
SGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLESGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 236 - DNA, 1971 bp, Artificial Sequence
  Me_l1_Si_l2_S2
tcagggtccgtagttgagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 237 - protein, 687 aa, Artificial Sequence
  Mf_l1_Sh_l2_S2
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 238 - DNA, 2061 bp, Artificial Sequence
  Mf_l1_Sh_l2_S2
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 239 - protein, 658 aa, Artificial Sequence
  Mf_l1_Si_l2_S2
EQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 240 - DNA, 1974 bp, Artificial Sequence
  Mf_l1_Si_l2_S2
gagcaggcagagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 241 - protein, 684 aa, Artificial Sequence
  Mg_l1_Sh_l2_S2
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 242 - DNA, 2052 bp, Artificial Sequence
  Mg_l1_Sh_l2_S2
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtagggtagttccctcaggcgatgtagttagatttccaaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatcagtgcgtcaattttaactttaatggcctgacaggtactggtgttcttactagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 243 - protein, 655 aa, Artificial Sequence
  Mg_l1_Si_l2_S2
EGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKSGGGSGGGSGGGSNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNSGGSGGSGGSGGSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNK

SEQ ID NO: 244 - DNA, 1965 bp, Artificial Sequence
  Mg_l1_Si_l2_S2
gagggcgtagagtgcgacttctcccccttgctttccgggactccaccccaggtgtataattttaaaaggcttgtctttactaactgcaactacaacttgaccaaacttctgagtctgttttctgttaatgacttcacatgctctcaaatatcacctgccgctatcgctagtaactgttacagctctcttatcttggattatttctcttatcccctctctatgaaatctgatctcagtgtaagtagtgcaggacccatttcccagtttaattacaaacaatcattctcaaatccaacatgcttgatactggctactgtccctcataacctgaccacaatcactaaaccactcaagtattcatacatcaacaagtgttcccgcctcctgtcagacgatcgaacagaggtccctcagttggtaaacgctaatcaatattcaccatgcgtgagcattgtcccaagcaccgtctgggaagatggggattactataggaaacagttgtcacctcttgagggagggggctggttggtcgcatccggtagcacagtggctatgactgaacagctgcaaatgggtttcggcataaccgtgcagtatgggaccgatacaaactccgtgtgtccaaaattggaatttgctaacgacacaaaatctgggggaggaagtggagggggtagtggtggaggaagtaacataaccaacttgtgccccttcggggaggtattcaacgccaccaagttccccagtgtatatgcctgggagcggaaaaagatttctaattgcgttgctgattatagcgtactgtacaatagtacatttttttcaaccttcaaatgctacggtgttagcgccactaagctcaatgacttgtgcttttcaaatgtgtacgctgacagctttgttgtaaaaggcgacgatgtccgacagatagcacctggacaaactggtgtgattgcagattacaattacaaattgcccgacgattttatggggtgtgtgctcgcatggaatacccggaacattgatgctacctcaacaggaaactataactacaagtatcgatacttgcgacacgggaaactgaggccatttgagcgtgacatatcaaatgtgccattttcccccgacggaaaaccatgtactcctcccgctctgaattgctactggcccctgaacgattacggattctatactactaccggcattggctatcaaccttacagggttgtagtccttagctttgagttgctcaacgctcctgcaaccgtatgtgggccaaagctctcaactgatctcatcaaaaatagcggcggatcagggggtagcggcggctccggtggctctaatatcactaatctttgccccttcggggaagtatttaacgctactcgatttgctagcgtatatgcctggaaccggaagagaataagcaactgtgttgcagactatagcgtgctttacaattccgcatcctttagtaccttcaaatgttacggtgtgagccccaccaaactcaatgatctctgtttcacaaacgtgtacgcagatagtttcgttatacgcggggacgaagtacggcagatagcccctggccagacaggaaagatagccgattacaactacaaacttccagacgattttacagggtgtgtgatcgcttggaattcaaataacctggactccaaagtgggaggcaactataattacctgtaccgactgttccgcaaaagcaacttgaaacctttcgagcgagatatatcaaccgaaatctaccaagctggttctacaccttgtaatggtgtggagggatttaactgctacttccctcttcagtcctatggatttcagcctacaaatggagtcgggtatcaaccctatagagtcgtggtgttgtcatttgaacttctccatgcacctgctactgtctgtggtccaaaaaagtccactaatcttgtaaaaaacaaa

SEQ ID NO: 245 - protein, 207 aa, Artificial Sequence
  BA.X-1-monomer
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 246 - protein, 207 aa, Artificial Sequence
  BA.X-2-monomer
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 247 - protein, 207 aa, Artificial Sequence
  BA.X-3-monomer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 248 - protein, 207 aa, Artificial Sequence
  BA.X-4-monomer
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNK

SEQ ID NO: 249 - protein, 207 aa, Artificial Sequence
  BA.X-5-monomer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNK

SEQ ID NO: 250 - protein, 207 aa, Artificial Sequence
  BA.X-6-monomer
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNK

SEQ ID NO: 251 - protein, 207 aa, Artificial Sequence
  BA.X-7-monomer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 252 - protein, 207 aa, Artificial Sequence
  BA.X-8-monomer
NITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNK

SEQ ID NO: 253 - protein, 207 aa, Artificial Sequence
  BA.X-9-monomer
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNK

SEQ ID NO: 254 - protein, 207 aa, Artificial Sequence
  BA.X-10-monomer
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 255 - protein, 447 aa, Artificial Sequence
  BA.X-1-monomer-Fc
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 256 - protein, 447 aa, Artificial Sequence
  BA.X-2-monomer-Fc
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 257 - protein, 447 aa, Artificial Sequence
  BA.X-3-monomer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 258 - protein, 447 aa, Artificial Sequence
  BA.X-4-monomer-Fc
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 259 - protein, 447 aa, Artificial Sequence
  BA.X-5-monomer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 260 - protein, 447 aa, Artificial Sequence
  BA.X-6-monomer-Fc
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 261 - protein, 447 aa, Artificial Sequence
  BA.X-7-monomer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 262 - protein, 447 aa, Artificial Sequence
  BA.X-8-monomer-Fc
NITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 263 - protein, 447 aa, Artificial Sequence
  BA.X-9-monomer-Fc
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 264 - protein, 447 aa, Artificial Sequence
  BA.X-10-monomer-Fc
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 265 - protein, 426 aa, Artificial Sequence
  BA.X-1-dimer
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 266 - protein, 426 aa, Artificial Sequence
  BA.X-2-dimer
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 267 - protein, 426 aa, Artificial Sequence
  BA.X-3-dimer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 268 - protein, 426 aa, Artificial Sequence
  BA.X-4-dimer
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNK

SEQ ID NO: 269 - protein, 426 aa, Artificial Sequence
  BA.X-5-dimer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNK

SEQ ID NO: 270 - protein, 426 aa, Artificial Sequence
  BA.X-6-dimer
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNKGSGGGGSGGGGSNITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNK

SEQ ID NO: 271 - protein, 426 aa, Artificial Sequence
  BA.X-7-dimer
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 272 - protein, 426 aa, Artificial Sequence
  BA.X-8-dimer
NITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKGSGGGGSGGGGSNITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNK

SEQ ID NO: 273 - protein, 426 aa, Artificial Sequence
  BA.X-9-dimer
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNKGSGGGGSGGGGSNITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNK

SEQ ID NO: 274 - protein, 426 aa, Artificial Sequence
  BA.X-10-dimer
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNK

SEQ ID NO: 275 - protein, 666 aa, Artificial Sequence
  BA.X-1-dimer-Fc
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 276 - protein, 666 aa, Artificial Sequence
  BA.X-2-dimer-Fc
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 277 - protein, 666 aa, Artificial Sequence
  BA.X-3-dimer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 278 - protein, 666 aa, Artificial Sequence
  BA.X-4-dimer-Fc
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 279 - protein, 666 aa, Artificial Sequence
  BA.X-5-dimer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVKGFNCYFPLRSYGFQPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 280 - protein, 666 aa, Artificial Sequence
  BA.X-6-dimer-Fc
NITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNKGSGGGGSGGGGSNITNLCPFDEVFNATRFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLQSYGFQPTYGVGYQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 281 - protein, 666 aa, Artificial Sequence
  BA.X-7-dimer-Fc
NITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 282 - protein, 666 aa, Artificial Sequence
  BA.X-8-dimer-Fc
NITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKGSGGGGSGGGGSNITNLCPFDEVFNATRFASVYAWNRKRISNCVADYSVLYNLASFSTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 283 - protein, 666 aa, Artificial Sequence
  BA.X-9-dimer-Fc
NITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNKGSGGGGSGGGGSNITNLCPFDEVFNATKFASVYAWNRKRISNCVADYSVLYNSASFSAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVKGFNCYFPLRSYSFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 284 - protein, 666 aa, Artificial Sequence
  BA.X-10-dimer-Fc
NITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGSGGGGSNITNLCPFDEVFNATRFASVYAWNRKRISNCVADYSVLYNSAPFSAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGFNCYFPLRSYGFRPTYGVGHQPYRVVVLSFELLHAPATVCGPKKSTNLVKNKGSGGGGDGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELTKNQVSLTCLVKGFYPSDIAVEWESNGQPENNYKTTPPVLDSDGSFFLYSKLTVDKSRWQQGNVFSCSVMHEALHNHYTQKSLSLSPGS

SEQ ID NO: 285 - DNA, 621 bp, Artificial Sequence
  BA.X-1-monomer
aatatcacaaatctctgcccatttgacgaagtatttaacgccaccaagtttgcttcagtctatgcttggaaccggaaaaggatttctaattgtgtagccgactatagtgtcctctacaattccgcctcattttcagcctttaaatgctacggtgtatcacctactaagctcaacgatttgtgttttacaaacgtgtatgctgattcctttgtgattcgtggcaacgaagtttctcagatagcccctggtcagactggcaacattgcagattacaactataaactgccagatgactttactgggtgtgttatagcctggaatagtaataaacttgactcaaaagtcggtgggaactataactatcgttatcgactctttcgtaaatcaaacctgaagcctttcgagagagatatatctacagagatttaccaagctggtaacaaaccttgcaacggagtagctggctttaattgttatttccctctgcgttcctatggttttcgaccaacctacggggtgggtcatcagccataccgggtcgtagtgctgagcttcgaactgttgcacgcccctgcaaccgtgtgcggccctaaaaagtcaactaacctggttaagaataag

SEQ ID NO: 286 - DNA, 621 bp, Artificial Sequence
  BA.X-2-monomer
aacatcactaatctgtgcccttttgacgaggtgttcaacgcaacccgatttgcctcagtctatgcatggaacagaaagcgcatcagtaactgcgttgccgattatagcgttttgtataactctgcaccattctctgcattcaagtgttatggtgtgtcacctacaaagctcaatgacctttgtttcaccaatgtgtatgctgactcttttgtgatccgagggaacgaggtaagtcagattgcacccggacagaccggtaatattgctgactacaattacaaattgccagatgactttacaggatgcgtcattgcttggaactccaacaagctcgatagcaaagtgggggggaattataactatctttatcgactgttccgtaagtcaaatttgaaaccatttgagcgcgatataagtacagagatttaccaggcagggaacaagccttgcaacggggtcgctggttttaattgttacttccctctgaggagttatggatttcgtccaacatatggtgtgggccatcaaccataccgagttgtagtccttagtttcgagttgctccatgctccagccacagtttgtggccccaaaaaaagcaccaaccttgtaaagaacaag

SEQ ID NO: 287 - DNA, 621 bp, Artificial Sequence
  BA.X-3-monomer
aacattaccaacctgtgtcccttcgacgaggtcttcaacgcaacacggttcgcctcagtctatgcttggaaccgaaaacgtatctccaactgcgtcgcagactatagcgtcttgtacaatttcgctccttttttcgcatttaagtgctacggcgtgtccccaactaaattgaatgacttgtgttttactaatgtgtatgctgactccttcgtaattcgcggtaacgaggtatcccagatagcacctggtcagaccggcaacatagccgattataactacaaactgcctgatgattttaccggatgtgtgatcgcttggaattccaataaacttgacagtaaagttggaggcaattacaattatcgctatagactgttcagaaaaagtaatttgaagccttttgaaagagacattagtacagagatataccaagccggaaataaaccttgtaacggcgttgcagggtttaattgttacttccccctgcgatcatacgggtttcgtccaacctatggggtagggcaccaaccttacagagtagttgttctgagttttgagctcttgcacgcacctgctacagtttgcggacccaagaaatccacaaatttggtgaagaataag

SEQ ID NO: 288 - DNA, 621 bp, Artificial Sequence
  BA.X-4-monomer
aatataaccaatctctgtcctttcgacgaagttttcaacgccactcggtttgcctctgtgtatgcatggaatcgaaaaagaatttcaaattgcgtggccgattactctgttctttacaacagtgcatccttctccgctttcaaatgttatggagtgagtccaaccaagcttaatgatctttgcttcaccaacgtctatgcagactcatttgttatacgtgggaatgaagtttctcagatcgcccctggacagaccggcaacattgcagactacaattacaagctgcctgatgattttacaggttgcgtaatcgcctggaactcaaacaagctcgattccaaagtaggggggaattacaactacagataccgattgtttcgtaaaagcaatctgaaaccttttgagcgtgatatttctactgaaatttaccaagctggaaataagccttgtaatggggttaagggatttaattgttacttccctttgaggtcttacggtttccgccccacttatggcgtaggacaccaaccatatcgggtggtggtcctttcattcgagctgctgcacgcaccagcaactgtttgcggaccaaagaagtcaaccaacctggttaaaaataaa

SEQ ID NO: 289 - DNA, 621 bp, Artificial Sequence
  BA.X-5-monomer
aacattacaaacctgtgtccttttgacgaggtgttcaatgctactcggttcgcatccgtttatgcatggaaccgtaaacgcatctcaaattgtgtcgccgactactcagtgctctacaactttgccccattctttgcatttaagtgttacggtgtatcacccaccaagctcaacgacctctgcttcactaacgtttatgccgattcctttgtgataaggggcaacgaagtgagccaaatcgcccccggacaaactggtaacatcgccgattataattataaacttcccgacgactttactgggtgcgtgatagcatggaactcaaacaaactcgattccaaggtcggcggtaattataattatcggtataggctcttccgtaagtctaatctcaaacctttcgaacgggatatttcaacagagatttatcaggctgggaataaaccatgtaacggagtaaagggcttcaactgttactttccccttcgaagctacggtttccagccaacctacggggtgggccaccagccctaccgtgtagtcgtccttagcttcgagttgctccatgccccagccactgtgtgcggaccaaagaagagcaccaatcttgttaagaataag

SEQ ID NO: 290 - DNA, 621 bp, Artificial Sequence
  BA.X-6-monomer
aatatcacaaatctctgtccttttgatgaggtttttaatgcaacacgctttgccagcgtctatgcatggaaccggaaaagaataagtaattgcgtagcagattactctgtcctctataattctgcatcattctctgcattcaaatgttatggggttagtcccacaaagttgaacgatctttgcttcaccaacgtatatgcagacagcttcgtcattagggggaacgaagtatcacagatcgctcccggacaaactgggaacatagccgactacaattataagttgcctgatgactttacaggttgcgtcattgcttggaactcaaataaactcgattccaaggtcggcggcaattataactatctttataggcttttccgtaagtctaatctgaagccttttgagagagatatatctactgaaatctaccaggcaggtaataagccttgtaacggcgtagctggtttcaactgttatttcccccttcaatcatatggtttccaaccaacctacggagtcgggtatcagccttaccgcgtagtagttcttagtttcgagttgcttcatgctccagccaccgtgtgtggtcctaagaaatcaacaaatctcgtcaaaaataaa

SEQ ID NO: 291 - DNA, 621 bp, Artificial Sequence
  BA.X-7-monomer
aacatcacaaacctttgtccttttgatgaggtatttaatgccaccaggttcgcatctgtctacgcatggaatagaaaacggatctctaattgcgttgccgattatagcgtgctttacaacttcgctcccttctttgcttttaagtgctatggagtcagcccaacaaagctcaatgatctctgtttcacaaatgtttacgcagatagctttgtcatccgcggcaacgaggtttcccaaatagcaccaggtcagactggtaacatcgcagactataactataaactcccagacgattttactgggtgtgttattgcttggaatagcaataagttggactctaaggtcggtggaaactataattatttgtatagattgttcagaaaaagtaacctcaaaccattcgagagagacatttcaactgagatataccaagcaggtaacaaaccttgcaatggggtagcaggttttaattgctatttcccactgcgaagctatggtttccgtccaacctatggtgtcggccatcagccttaccgcgtagtggtcctctcctttgaacttcttcacgctcctgcaacagtttgtggccccaaaaagtcaacaaacctcgtcaaaaataag

SEQ ID NO: 292 - DNA, 621 bp, Artificial Sequence
  BA.X-8-monomer
aatattacaaatctctgcccatttgacgaagtcttcaatgcaacccgcttcgcttcagtctacgcctggaaccgcaagcgcatcagcaactgtgtagccgattatagtgttctctataatttggcctctttctccaccttcaaatgttatggtgtcagccctactaaacttaacgacctctgctttaccaacgtatatgccgattcattcgtgatccgtggcgatgaggtgcgccagattgccccagggcaaaccggcaacatagccgactataactataagctccccgatgacttcactggttgcgtaatcgcttggaattccaataaactcgactccaaagtcagtggtaactataattacctctatcgcctctttcggaaatcaaatctcaagcctttcgaacgcgatatttccacagaaatataccaggcaggtaataagccatgtaacggggtcgccgggttcaattgctattttcctcttaggtcatactcctttcggcccacttatggcgtgggacaccagccttaccgcgttgtagtgctttcctttgaattgctgcatgccccagctactgtctgtgggcctaagaagagtaccaatcttgtgaagaataag

SEQ ID NO: 293 - DNA, 621 bp, Artificial Sequence
  BA.X-9-monomer
aacattaccaatctgtgtccttttgacgaagtcttcaatgctacaaaatttgctagcgtctacgcatggaaccgtaaacgaataagtaactgcgtggccgactactctgtcttgtataactctgccagcttctcagccttcaagtgctatggtgttagcccaaccaaactgaatgacctgtgttttaccaacgtctacgccgattccttcgtcatccgtggtaacgaggtctctcaaatagcacccggacaaacagggaatatcgcagattacaattataaacttcctgatgactttactggctgcgtgatcgcttggaatagcaataaactggattctaaggtgtccggcaactataattaccgatatcgcctctttcgcaagtctaatctcaaaccctttgaacgcgacatcagcacagaaatctatcaagctggcaataagccctgcaacggggttaagggattcaactgttattttcccctcaggtcatattcctttagacctacttacggtgtaggccatcagccctatcgtgtggtagtgcttagtttcgaactgcttcacgctcccgctacagtttgcggaccaaaaaagtctaccaatctggttaagaataaa

SEQ ID NO: 294 - DNA, 621 bp, Artificial Sequence
  BA.X-10-monomer
aacatcacaaacttgtgcccttttgatgaagtgttcaacgctactcgctttgcctcagtctacgcttggaacagaaagcggataagcaattgtgtcgcagactactccgttctctataactctgccccctttagcgcattcaaatgttacggagtgtctcctactaaacttaacgatctctgctttacaaacgtatatgctgattccttcgtgattagggggaacgaggtctcccaaattgcacccggccagaccgggaacatcgcagactataactacaagctgcctgatgattttactggatgcgttatcgcctggaatagcaacaaactcgacagtaaagttggcgggaactacaactacagataccgtctttttcggaaaagcaatctcaaaccttttgaaagagacatatcaacagaaatatatcaggcaggcaataaaccttgtaatggagtagctggattcaactgttactttccacttcggagttacgggtttcgtccaacatatggtgtcgggcaccaaccttatcgtgtagtagtgctcagttttgaacttcttcacgctccagctaccgtgtgtggtcctaagaaatccaccaatctggtgaagaacaag

SEQ ID NO: 295 - DNA, 1344 bp, Artificial Sequence
  BA.X-1-monomer-Fc
aatatcacaaatctctgcccatttgacgaagtatttaacgccaccaagtttgcttcagtctatgcttggaaccggaaaaggatttctaattgtgtagccgactatagtgtcctctacaattccgcctcattttcagcctttaaatgctacggtgtatcacctactaagctcaacgatttgtgttttacaaacgtgtatgctgattcctttgtgattcgtggcaacgaagtttctcagatagcccctggtcagactggcaacattgcagattacaactataaactgccagatgactttactgggtgtgttatagcctggaatagtaataaacttgactcaaaagtcggtgggaactataactatcgttatcgactctttcgtaaatcaaacctgaagcctttcgagagagatatatctacagagatttaccaagctggtaacaaaccttgcaacggagtagctggctttaattgttatttccctctgcgttcctatggttttcgaccaacctacggggtgggtcatcagccataccgggtcgtagtgctgagcttcgaactgttgcacgcccctgcaaccgtgtgcggccctaaaaagtcaactaacctggttaagaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 296 - DNA, 1344 bp, Artificial Sequence
  BA.X-2-monomer-Fc
aacatcactaatctgtgcccttttgacgaggtgttcaacgcaacccgatttgcctcagtctatgcatggaacagaaagcgcatcagtaactgcgttgccgattatagcgttttgtataactctgcaccattctctgcattcaagtgttatggtgtgtcacctacaaagctcaatgacctttgtttcaccaatgtgtatgctgactcttttgtgatccgagggaacgaggtaagtcagattgcacccggacagaccggtaatattgctgactacaattacaaattgccagatgactttacaggatgcgtcattgcttggaactccaacaagctcgatagcaaagtgggggggaattataactatctttatcgactgttccgtaagtcaaatttgaaaccatttgagcgcgatataagtacagagatttaccaggcagggaacaagccttgcaacggggtcgctggttttaattgttacttccctctgaggagttatggatttcgtccaacatatggtgtgggccatcaaccataccgagttgtagtccttagtttcgagttgctccatgctccagccacagtttgtggccccaaaaaaagcaccaaccttgtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 297 - DNA, 1344 bp, Artificial Sequence
  BA.X-3-monomer-Fc
aacattaccaacctgtgtcccttcgacgaggtcttcaacgcaacacggttcgcctcagtctatgcttggaaccgaaaacgtatctccaactgcgtcgcagactatagcgtcttgtacaatttcgctccttttttcgcatttaagtgctacggcgtgtccccaactaaattgaatgacttgtgttttactaatgtgtatgctgactccttcgtaattcgcggtaacgaggtatcccagatagcacctggtcagaccggcaacatagccgattataactacaaactgcctgatgattttaccggatgtgtgatcgcttggaattccaataaacttgacagtaaagttggaggcaattacaattatcgctatagactgttcagaaaaagtaatttgaagccttttgaaagagacattagtacagagatataccaagccggaaataaaccttgtaacggcgttgcagggtttaattgttacttccccctgcgatcatacgggtttcgtccaacctatggggtagggcaccaaccttacagagtagttgttctgagttttgagctcttgcacgcacctgctacagtttgcggacccaagaaatccacaaatttggtgaagaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 298 - DNA, 1344 bp, Artificial Sequence
  BA.X-4-monomer-Fc
aatataaccaatctctgtcctttcgacgaagttttcaacgccactcggtttgcctctgtgtatgcatggaatcgaaaaagaatttcaaattgcgtggccgattactctgttctttacaacagtgcatccttctccgctttcaaatgttatggagtgagtccaaccaagcttaatgatctttgcttcaccaacgtctatgcagactcatttgttatacgtgggaatgaagtttctcagatcgcccctggacagaccggcaacattgcagactacaattacaagctgcctgatgattttacaggttgcgtaatcgcctggaactcaaacaagctcgattccaaagtaggggggaattacaactacagataccgattgtttcgtaaaagcaatctgaaaccttttgagcgtgatatttctactgaaatttaccaagctggaaataagccttgtaatggggttaagggatttaattgttacttccctttgaggtcttacggtttccgccccacttatggcgtaggacaccaaccatatcgggtggtggtcctttcattcgagctgctgcacgcaccagcaactgtttgcggaccaaagaagtcaaccaacctggttaaaaataaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 299 - DNA, 1344 bp, Artificial Sequence
  BA.X-5-monomer-Fc
aacattacaaacctgtgtccttttgacgaggtgttcaatgctactcggttcgcatccgtttatgcatggaaccgtaaacgcatctcaaattgtgtcgccgactactcagtgctctacaactttgccccattctttgcatttaagtgttacggtgtatcacccaccaagctcaacgacctctgcttcactaacgtttatgccgattcctttgtgataaggggcaacgaagtgagccaaatcgcccccggacaaactggtaacatcgccgattataattataaacttcccgacgactttactgggtgcgtgatagcatggaactcaaacaaactcgattccaaggtcggcggtaattataattatcggtataggctcttccgtaagtctaatctcaaacctttcgaacgggatatttcaacagagatttatcaggctgggaataaaccatgtaacggagtaaagggcttcaactgttactttccccttcgaagctacggtttccagccaacctacggggtgggccaccagccctaccgtgtagtcgtccttagcttcgagttgctccatgccccagccactgtgtgcggaccaaagaagagcaccaatcttgttaagaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 300 - DNA, 1344 bp, Artificial Sequence
  BA.X-6-monomer-Fc
aatatcacaaatctctgtccttttgatgaggtttttaatgcaacacgctttgccagcgtctatgcatggaaccggaaaagaataagtaattgcgtagcagattactctgtcctctataattctgcatcattctctgcattcaaatgttatggggttagtcccacaaagttgaacgatctttgcttcaccaacgtatatgcagacagcttcgtcattagggggaacgaagtatcacagatcgctcccggacaaactgggaacatagccgactacaattataagttgcctgatgactttacaggttgcgtcattgcttggaactcaaataaactcgattccaaggtcggcggcaattataactatctttataggcttttccgtaagtctaatctgaagccttttgagagagatatatctactgaaatctaccaggcaggtaataagccttgtaacggcgtagctggtttcaactgttatttcccccttcaatcatatggtttccaaccaacctacggagtcgggtatcagccttaccgcgtagtagttcttagtttcgagttgcttcatgctccagccaccgtgtgtggtcctaagaaatcaacaaatctcgtcaaaaataaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 301 - DNA, 1344 bp, Artificial Sequence
  BA.X-7-monomer-Fc
aacatcacaaacctttgtccttttgatgaggtatttaatgccaccaggttcgcatctgtctacgcatggaatagaaaacggatctctaattgcgttgccgattatagcgtgctttacaacttcgctcccttctttgcttttaagtgctatggagtcagcccaacaaagctcaatgatctctgtttcacaaatgtttacgcagatagctttgtcatccgcggcaacgaggtttcccaaatagcaccaggtcagactggtaacatcgcagactataactataaactcccagacgattttactgggtgtgttattgcttggaatagcaataagttggactctaaggtcggtggaaactataattatttgtatagattgttcagaaaaagtaacctcaaaccattcgagagagacatttcaactgagatataccaagcaggtaacaaaccttgcaatggggtagcaggttttaattgctatttcccactgcgaagctatggtttccgtccaacctatggtgtcggccatcagccttaccgcgtagtggtcctctcctttgaacttcttcacgctcctgcaacagtttgtggccccaaaaagtcaacaaacctcgtcaaaaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 302 - DNA, 1344 bp, Artificial Sequence
  BA.X-8-monomer-Fc
aatattacaaatctctgcccatttgacgaagtcttcaatgcaacccgcttcgcttcagtctacgcctggaaccgcaagcgcatcagcaactgtgtagccgattatagtgttctctataatttggcctctttctccaccttcaaatgttatggtgtcagccctactaaacttaacgacctctgctttaccaacgtatatgccgattcattcgtgatccgtggcgatgaggtgcgccagattgccccagggcaaaccggcaacatagccgactataactataagctccccgatgacttcactggttgcgtaatcgcttggaattccaataaactcgactccaaagtcagtggtaactataattacctctatcgcctctttcggaaatcaaatctcaagcctttcgaacgcgatatttccacagaaatataccaggcaggtaataagccatgtaacggggtcgccgggttcaattgctattttcctcttaggtcatactcctttcggcccacttatggcgtgggacaccagccttaccgcgttgtagtgctttcctttgaattgctgcatgccccagctactgtctgtgggcctaagaagagtaccaatcttgtgaagaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 303 - DNA, 1344 bp, Artificial Sequence
  BA.X-9-monomer-Fc
aacattaccaatctgtgtccttttgacgaagtcttcaatgctacaaaatttgctagcgtctacgcatggaaccgtaaacgaataagtaactgcgtggccgactactctgtcttgtataactctgccagcttctcagccttcaagtgctatggtgttagcccaaccaaactgaatgacctgtgttttaccaacgtctacgccgattccttcgtcatccgtggtaacgaggtctctcaaatagcacccggacaaacagggaatatcgcagattacaattataaacttcctgatgactttactggctgcgtgatcgcttggaatagcaataaactggattctaaggtgtccggcaactataattaccgatatcgcctctttcgcaagtctaatctcaaaccctttgaacgcgacatcagcacagaaatctatcaagctggcaataagccctgcaacggggttaagggattcaactgttattttcccctcaggtcatattcctttagacctacttacggtgtaggccatcagccctatcgtgtggtagtgcttagtttcgaactgcttcacgctcccgctacagtttgcggaccaaaaaagtctaccaatctggttaagaataaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 304 - DNA, 1344 bp, Artificial Sequence
  BA.X-10-monomer-Fc
aacatcacaaacttgtgcccttttgatgaagtgttcaacgctactcgctttgcctcagtctacgcttggaacagaaagcggataagcaattgtgtcgcagactactccgttctctataactctgccccctttagcgcattcaaatgttacggagtgtctcctactaaacttaacgatctctgctttacaaacgtatatgctgattccttcgtgattagggggaacgaggtctcccaaattgcacccggccagaccgggaacatcgcagactataactacaagctgcctgatgattttactggatgcgttatcgcctggaatagcaacaaactcgacagtaaagttggcgggaactacaactacagataccgtctttttcggaaaagcaatctcaaaccttttgaaagagacatatcaacagaaatatatcaggcaggcaataaaccttgtaatggagtagctggattcaactgttactttccacttcggagttacgggtttcgtccaacatatggtgtcgggcaccaaccttatcgtgtagtagtgctcagttttgaacttcttcacgctccagctaccgtgtgtggtcctaagaaatccaccaatctggtgaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 305 - DNA, 1278 bp, Artificial Sequence
  BA.X-1-dimer
aatataactaacttgtgtcccttcgacgaggtattcaatgctactaaatttgcctccgtgtacgcttggaataggaaaagaatcagtaactgtgttgctgactacagcgtgttgtacaacagcgccagtttctctgcctttaaatgctacggagtatcacccactaagctcaatgatctgtgctttacaaatgtctacgcagattctttcgttatcagaggcaatgaggtatcccaaatcgcacccggccaaactggtaatattgccgattacaactataagcttcctgatgattttaccggatgtgtaatagcttggaatagtaacaagttggactctaaagtgggtggtaattataattacaggtacagactgttcagaaagtccaaccttaaaccttttgaacgggacatctctacagaaatctaccaagccggcaacaagccatgtaatggggtggccggttttaactgttatttccccttgcgctcctatgggttcaggccaacctatggggttggccatcagccttatcgggtagtagtactctccttcgagcttttgcatgcacctgcaacagtatgcggacctaaaaagagcactaatttggttaagaataagggctccgggggaggtgggagtggaggaggaggcagtaacataactaatctttgtccattcgatgaagtcttcaatgctacaaagtttgctagtgtatatgcctggaacagaaagcgaatcagtaattgcgtggctgactatagcgtactctataatagcgcatccttctcagcctttaagtgctatggagtaagccccaccaagctgaatgacctctgttttacaaatgtttacgccgatagttttgtcattcgaggtaacgaagtaagccagatcgctcctggccagacaggcaatatcgcagattacaactacaagctgccagacgactttacaggctgcgttatcgcctggaacagtaataagctcgattctaaggtaggaggtaactataactatcgttatcggttgtttaggaagagtaatttgaaaccatttgagagagatatatcaactgaaatataccaagccggtaacaagccttgtaatggtgttgctgggttcaattgttatttcccccttcggtcttatggtttcagacccacatatggtgttggtcaccagccttaccgagtagttgtcctttcttttgaacttctgcacgcacctgccacagtctgcggcccaaagaaaagcactaaccttgtaaagaacaag

SEQ ID NO: 306 - DNA, 1278 bp, Artificial Sequence
  BA.X-2-dimer
aacataaccaacctttgcccctttgatgaagtgttcaatgctaccaggttcgcatctgtatacgcctggaacaggaagcgaatatcaaattgcgtggctgattattcagtactttacaattccgctccattttcagcattcaagtgctatggcgtatcccccactaagcttaacgatttgtgtttcaccaatgtctacgctgatagcttcgttatcaggggcaacgaggtgtcccagattgccccagggcaaactggaaatattgccgattacaactacaaactcccagatgatttcactgggtgcgttatagcctggaattcaaataagctggatagtaaggttggtgggaactacaattacctttaccgactctttcggaaatcaaatcttaagccattcgaacgcgacataagtactgaaatatatcaagctggcaataaaccatgcaacggagtagctgggtttaactgttacttcccattgcggtcttatggttttagacctacttatggtgttggccatcagccctatcgggtggtagtccttagtttcgaactcctccatgcccctgccacagtctgcggaccaaaaaagtcaacaaatctcgtaaaaaacaaagggagtggagggggagggtccggaggagggggaagtaatatcacaaacctgtgccctttcgacgaagttttcaacgctacccgattcgcatctgtgtacgcatggaataggaaaagaatttctaattgtgtagctgactacagcgtactctacaattcagcacccttttctgccttcaaatgctacggcgtcagccccacaaagttgaatgacttgtgctttaccaacgtgtatgcagactcctttgtaatacgaggaaacgaggtttctcagatcgctcctggccaaactgggaacattgcagactacaattacaaattgcccgacgattttaccgggtgcgtcatagcttggaattctaacaaattggacagcaaagtgggaggtaattataattatctctatagattgtttcgaaagtcaaacctgaaacctttcgaaagagacatttctacagaaatctaccaagctgggaataagccttgcaacggtgtggccggtttcaattgctactttcctctcaggtcttatggtttcagacccacttacggagttggccatcaaccctatcgcgtggtcgtccttagttttgagttgctgcacgctccagcaaccgtctgcgggccaaagaaatcaacaaacctggtcaaaaataag

SEQ ID NO: 307 - DNA, 1278 bp, Artificial Sequence
  BA.X-3-dimer
aacatcacaaacttgtgtcccttcgacgaggtgtttaatgcaacacggtttgccagtgtttacgcttggaaccgtaagcgtataagcaactgtgtagcagactattctgtgttgtataattttgcaccattttttgcatttaagtgttatggagtatcccccacaaagctgaacgacctctgcttcacaaacgtttacgccgactccttcgtaatcaggggtaacgaagtctctcagatcgctcctggccaaacaggtaatatagcagactataattacaaacttcccgacgatttcacaggttgtgtgatcgcctggaactccaataagttggattcaaaggtagggggcaattataattatagatatcgtctcttccgcaaatctaacctcaaaccattcgagcgtgacataagcaccgagatctatcaagcaggtaacaagccatgcaatggagtggcaggtttcaattgctattttccattgagatcatatggtttccgtccaacctacggagtcggacaccagccttatcgtgtcgtggtccttagtttcgagttgcttcacgcaccagccaccgtttgcgggcccaaaaaatctactaacttggtaaagaataagggtagtgggggtggtggctccggtgggggtgggagtaatattacaaatctttgcccattcgatgaagtcttcaatgccactcgatttgcttctgtttatgcctggaacagaaaacggataagtaattgtgtagctgactacagtgtcctctataatttcgctccctttttcgctttcaaatgctatggcgtaagtccaaccaaattgaacgacctttgtttcacaaatgtgtacgcagacagtttcgtcattcgaggaaacgaggtttcacaaatagctcccgggcagacaggtaacattgcagattacaactataaacttcccgacgactttactgggtgcgtgatcgcctggaacagcaataagcttgattctaaagtcgggggaaactacaactacagataccggctgttccgcaaaagtaacctgaagcccttcgagagggacatttctaccgaaatatatcaagcaggaaacaagccttgcaatggggtggctggattcaattgctattttccattgcgatcctacgggtttcggcctacttatggtgtgggccatcaaccttatagagtagtggtcctgagcttcgagctccttcatgctccagcaacagtgtgcggcccaaaaaaatctacaaacttggttaagaacaaa

SEQ ID NO: 308 - DNA, 1278 bp, Artificial Sequence
  BA.X-4-dimer
aacatcactaacctctgtcccttcgatgaagtcttcaatgctacaagatttgcttccgtatatgcatggaaccgtaagcgcatttctaattgtgtagccgattattcagtactctataattcagctagtttcagtgcttttaagtgttacggggtatcccctactaaacttaatgacctgtgctttaccaacgtttatgccgattcttttgtcattcggggtaacgaggtatcacagattgctcctgggcaaaccggcaacattgccgattataactataaactgcccgacgattttaccggctgtgtgatcgcatggaatagcaacaaacttgactccaaggtcggtggcaattacaattaccgctatcggcttttcaggaaaagcaatcttaagcccttcgagcgtgacatttcaactgagatataccaggccggtaataaaccctgcaacggtgttaagggctttaattgttactttccactccgttcctatgggttccggccaacatatggggttggccaccagccctaccgggtggtggtcttgtcctttgaattgcttcacgctcccgctaccgtgtgtggtcccaaaaagagcactaatctggtcaaaaacaagggatcaggcggaggaggttccgggggaggggggagcaacatcaccaacctgtgcccctttgatgaggtcttcaacgccacaagattcgcttctgtttacgcatggaatcggaagcgtattagtaattgtgtggctgactacagcgttttgtataacagtgcaagtttcagtgcatttaagtgctacggcgtgagtcccaccaagcttaacgacctttgtttcactaatgtttacgctgacagttttgttataaggggcaatgaagtgtcacagatcgcccctggccaaacagggaatatcgccgactataactataagctccccgatgattttacaggatgtgttattgcttggaatagtaacaagctcgattcaaaggttggcggaaactataactacaggtatcgcctcttcagaaagagcaatcttaagccttttgaaagggatatatcaactgaaatatatcaagcagggaacaagccttgcaatggagtgaagggctttaactgctactttcccctccggagctacggctttagacctacctacggggtcggtcaccaaccttatcgagttgttgttctttcttttgaactgcttcatgcacccgcaacagtctgtgggccaaagaaaagtaccaacctggtgaagaacaag

SEQ ID NO: 309 - DNA, 1278 bp, Artificial Sequence
  BA.X-5-dimer
aacattacaaacctttgtccttttgacgaggtcttcaatgccactagatttgcttccgtgtatgcttggaatcggaagaggatcagtaactgtgttgcagactattcagtgctctacaattttgcaccttttttcgcctttaagtgttacggagtgtcccccacaaaactgaacgacctttgtttcactaacgtctatgccgacagctttgtcatccgggggaacgaagtgagtcagatagctcccggccaaactggaaacatagccgattataactacaagctgcccgatgatttcactggctgtgttatcgcatggaacagtaataaacttgactcaaaagttggaggaaactacaattacagataccgcctgttccggaaaagcaaccttaagcccttcgagcgtgacatatcaacagagatataccaagcaggaaacaagccatgtaatggggtcaaggggttcaactgctactttccactccggagttatggattccagcccacttatggagtcgggcatcagccctatcgcgttgtggttcttagtttcgagctgcttcatgctcctgccactgtgtgtggcccaaagaaaagcaccaatctcgtgaaaaataaggggtcaggcggtggtgggtccgggggaggaggaagcaacatcaccaatttgtgccctttcgacgaagtctttaatgctaccaggttcgcttcagtatatgcatggaaccgcaagaggataagcaattgcgtagccgattattccgtactctataatttcgccccctttttcgctttcaagtgctatggagtatcccctactaagttgaacgatctgtgttttactaacgtttacgctgattcatttgttatacgaggcaacgaagtttcacaaatcgcccccggacaaaccggaaatatagccgactataattacaagctgcctgacgatttcactggctgtgttatagcttggaactccaacaagttggatagtaaagtgggtgggaactacaactatcgatatcgactttttagaaagtcaaatctcaagccatttgagagagacatttccacagagatctatcaagctggcaacaaaccctgcaacggggtcaaaggcttcaactgttatttccctttgaggtcctatgggtttcagcctacttacggtgtggggcatcaaccctatagagtagtagttctgagttttgaattgcttcatgcacccgctactgtttgcgggccaaagaaaagtaccaacctggtgaagaacaag

SEQ ID NO: 310 - DNA, 1278 bp, Artificial Sequence
  BA.X-6-dimer
aacattactaacctgtgccctttcgacgaagtgttcaatgcaacaagatttgcatctgtctacgcctggaatagaaaacgtatatctaactgtgtagccgattacagtgtattgtacaatagcgcaagtttctccgcattcaaatgttatggggttagtcccactaaattgaacgacctctgctttacaaacgtgtacgcagattcctttgtgatacgcgggaatgaagtttcccagattgcccccgggcagacaggtaacatcgcagattataattataaactgccagatgacttcaccggttgtgttatcgcttggaactctaacaagctcgacagtaaagtaggcggcaactataactatctttaccgactgttcaggaaaagcaaccttaagcccttcgaacgagatataagtactgaaatctatcaggccgggaacaaaccatgtaatggggttgccggattcaactgttatttccccctccagtcctatggattccaaccaacctacggagtcggctaccaaccctaccgcgtcgtggtcttgagtttcgagttgcttcatgctcccgcaactgtttgcggaccaaagaaaagcacaaacctggttaagaacaagggaagtgggggcggaggaagcggcggtgggggttctaacataacaaatctgtgtccttttgatgaagtatttaatgctactagattcgcttctgtgtatgcctggaaccggaaacgtatttccaactgtgtagcagactactcagtactttataatagtgcaagcttttcagcattcaaatgctacggtgtcagccctaccaagttgaacgatttgtgtttcacaaacgtgtacgcagactcatttgtcattaggggaaacgaggttagccagatcgctcccggccagacaggcaacattgccgactacaattacaagttgccagacgactttactggctgtgtgattgcatggaactctaacaaattggactctaaagtgggtggtaactataattatctctaccgcttgtttaggaagagtaatcttaaaccattcgaacgcgatatttccaccgagatctaccaggcaggaaacaagccctgtaatggcgtggctggttttaattgctacttcccacttcagagctatggcttccaaccaacttatggagtgggttatcaaccctatcgagtcgtcgtactgtcttttgaactcctccatgccccagctacagtgtgcggaccaaaaaaaagtaccaatcttgtcaaaaacaaa

SEQ ID NO: 311 - DNA, 1278 bp, Artificial Sequence
  BA.X-7-dimer
aatataacaaacctgtgtcccttcgacgaagtattcaatgctacacggttcgcaagcgtttatgcatggaaccggaagcggatctccaactgcgttgccgattattcagtgctctataacttcgcccccttttttgcattcaaatgctacggggtcagtcccacaaaactgaacgacctgtgttttactaacgtatacgctgacagttttgtaatacgtggaaatgaagtctcacaaatcgcacccggtcagacagggaacatagctgactataattacaaactccctgacgattttactggatgcgtgatagcctggaattccaataaactcgacagtaaagtcgggggtaattataactatttgtatcgacttttccgcaagtcaaacctcaaaccctttgaacgagacatcagtacagagatataccaagctggaaataagccttgtaatggagtggcagggtttaactgctattttcctctcaggagctatggtttccgtccaacttacggggtgggacaccagccttaccgggtcgtcgtgttgtcctttgaattgctccacgcccctgcaaccgtatgcgggcccaaaaagagtaccaacttggttaagaataaggggagtggaggaggtggaagcgggggcgggggctcaaatattactaatttgtgcccattcgacgaggtctttaacgctacaagattcgcttctgtatatgcatggaatcgaaaacgcatttcaaactgtgtagccgattacagcgtcctctataactttgctccatttttcgctttcaagtgttacggcgttagtcccactaaactcaacgatctttgtttcacaaatgtgtacgcagactcatttgtaatccgagggaacgaggtatcccagatcgctcccgggcaaaccggaaacatcgcagattataactacaaacttcccgacgacttcactgggtgtgttatagcttggaattcaaataaacttgactcaaaagtgggagggaattataattacttgtatcggctgtttcgcaaatcaaacctcaaaccctttgaacgagatatttccaccgagatttaccaggcaggtaacaaaccatgcaatggagtcgctgggtttaactgctattttcctctgcggagctacggcttccggccaacatatggcgtcgggcaccaaccctacagggtggttgttctgagctttgaactcttgcacgctcctgccactgtttgcggacccaaaaaaagtactaaccttgtcaagaacaag

SEQ ID NO: 312 - DNA, 1278 bp, Artificial Sequence
  BA.X-8-dimer
aatataacaaatctctgccccttcgacgaagtattcaatgccacacggtttgcatcagtctatgcctggaaccgcaagaggattagtaattgcgtcgcagactattctgtgctgtacaatcttgcatccttttcaactttcaaatgttatggcgtctctccaacaaaactgaacgacctgtgttttacaaacgtttacgccgattccttcgtgataaggggtgatgaagtacggcaaattgcaccaggtcaaactggcaacatcgcagactacaactataagcttcctgacgacttcacaggttgtgtcatcgcatggaattctaacaaattggatagcaaagtgtcagggaattacaactacctttatcgtctctttagaaagtctaacctcaaaccattcgaaagagatatatctactgagatttatcaggcaggcaataagccatgtaatggggtggcaggatttaactgctattttccacttcgttcttactctttccggccaacttacggtgtcggacaccaaccctacagagtggtcgtgctgtctttcgaactcctgcatgcacccgccactgtctgtggacctaaaaagagcactaacctggtgaaaaataagggtagcgggggtggcggcagcggaggtgggggttcaaacataactaacctttgtccctttgacgaggtattcaacgcaactagatttgcatctgtctacgcttggaataggaagcggatctccaactgcgttgctgattacagtgtgctctacaacttggcatcttttagcacctttaagtgttacggggtaagccctacaaaactcaacgatctttgtttcactaacgtgtacgcagacagttttgtgattcgaggggatgaggttcgtcagatcgctccagggcaaacaggaaacatagctgactacaattacaagcttcctgacgacttcaccggatgcgtcattgcctggaactcaaataaactggactcaaaagtgagtgggaattataattacctgtataggctcttccggaagtcaaacctgaaacctttcgaaagggacatatcaacagagatttatcaagccggtaataaaccctgcaacggggtcgctggcttcaactgctactttccattgcgtagttatagctttcgaccaacttacggggtaggccatcaaccctacagagttgttgtcctgagtttcgaactgctgcatgctccagctactgtgtgtgggcctaagaaaagtaccaaccttgtcaaaaacaaa

SEQ ID NO: 313 - DNA, 1278 bp, Artificial Sequence
  BA.X-9-dimer
aacatcacaaacctctgtccctttgacgaggtgttcaacgctactaaattcgcctccgtctacgcttggaatcgcaagagaatctctaattgtgttgcagactacagtgtgctctataatagtgctagtttttccgccttcaaatgctacggtgtgtcaccaaccaagctcaatgatctttgttttacaaacgtttatgccgattccttcgttataaggggaaatgaggtctcacaaatcgctcccggtcaaactggaaatatagctgactacaactacaaactgccagacgacttcactggttgcgttatcgcatggaatagtaacaaattggattcaaaagttagcggcaattacaactataggtatcggcttttcaggaaatctaatctgaagcctttcgagagagacatatccactgaaatatatcaagctggtaataaaccctgtaatggggtaaaggggttcaattgttactttcctctgcgatcttatagcttccgacccacctacggagtcgggcaccagccataccgagtggtcgttctctccttcgagctcctgcacgcaccagcaacagtttgcgggcccaaaaaatcaactaatttggtgaaaaacaagggctcagggggtgggggttctggcggtggtggatcaaacatcactaacctgtgtccctttgatgaggtatttaacgctactaagtttgcatccgtttatgcctggaaccgaaagcggatctccaactgcgttgcagattactcagtactctacaacagcgcttccttctcagcatttaagtgctatggagtgagtcctactaagctgaacgatctgtgcttcacaaacgtttacgcagactcctttgtcattaggggtaacgaggtatctcagatagctccaggtcagactggaaacatcgcagactataactacaagcttcctgacgacttcactggctgcgtaattgcttggaatagtaacaaactggattctaaggtcagcggaaattacaactaccgctatagactgttccgtaaatcaaatctgaaaccatttgaaagagacatttctactgaaatctatcaggcaggtaacaagccctgcaacggagttaaggggttcaattgttacttccccttgcgaagctattctttcaggcccacctatggtgtaggacaccaaccttatagagtggttgtccttagctttgaactccttcacgccccagccaccgtttgtggccctaaaaagagtactaatctcgtaaaaaacaaa

SEQ ID NO: 314 - DNA, 1278 bp, Artificial Sequence
  BA.X-10-dimer
aacattacaaatctttgtcctttcgatgaggtctttaatgcaacacgcttcgcctccgtttacgcttggaatcggaagcgcatttcaaactgcgtcgctgactactccgtgctctacaactctgctccattcagcgcttttaagtgttatggcgtgtcacccacaaaacttaacgacttgtgtttcacaaacgtatacgccgacagtttcgtcatccgaggtaatgaagttagccagatagctcctggtcagaccggaaacatcgcagactacaattataaattgccagacgatttcacaggctgcgtgattgcttggaactctaataaactggactctaaagtgggcggaaactacaattatcgttaccgcctttttcggaaatccaatttgaaaccttttgaacgtgacatcagtactgaaatctatcaggcaggtaataagccatgcaatggggttgctggattcaattgttattttcccctccgttcatacggatttaggcccacctatggtgttggccatcaaccctaccgagtggtagtactctcatttgaactccttcacgctccagcaactgtatgtgggcccaaaaaaagtactaaccttgtcaagaataagggatcagggggtgggggtagcggcggcggcggctcaaacataactaacctttgccccttcgatgaggtgtttaatgctacccggtttgccagtgtctacgcatggaaccgcaaaaggatatccaattgtgtcgccgattacagtgtactgtataactccgctccttttagtgccttcaaatgttacggggtatccccaactaaactgaatgatctctgtttcactaatgtttatgctgattccttcgtgattcgggggaacgaagtgtcacagattgcccctggtcaaaccggtaatattgccgattataactacaaactcccagatgatttcaccgggtgtgttattgcctggaattcaaataagttggactccaaggtgggagggaattacaattatcggtatcgactttttcggaagtccaacctgaagcctttcgaacgcgatatttcaaccgagatctatcaggccgggaataagccttgtaacggggtggcaggatttaattgttatttccccctccgcagctatggcttccgtcctacatatggcgtgggacatcaaccctatcgagtggtggtactttcctttgaactgcttcacgcccctgccactgtttgcgggcctaagaagtctaccaatttggtaaagaacaaa

SEQ ID NO: 315 - DNA, 2001 bp, Artificial Sequence
  BA.X-1-dimer-Fc
aatataactaacttgtgtcccttcgacgaggtattcaatgctactaaatttgcctccgtgtacgcttggaataggaaaagaatcagtaactgtgttgctgactacagcgtgttgtacaacagcgccagtttctctgcctttaaatgctacggagtatcacccactaagctcaatgatctgtgctttacaaatgtctacgcagattctttcgttatcagaggcaatgaggtatcccaaatcgcacccggccaaactggtaatattgccgattacaactataagcttcctgatgattttaccggatgtgtaatagcttggaatagtaacaagttggactctaaagtgggtggtaattataattacaggtacagactgttcagaaagtccaaccttaaaccttttgaacgggacatctctacagaaatctaccaagccggcaacaagccatgtaatggggtggccggttttaactgttatttccccttgcgctcctatgggttcaggccaacctatggggttggccatcagccttatcgggtagtagtactctccttcgagcttttgcatgcacctgcaacagtatgcggacctaaaaagagcactaatttggttaagaataagggctccgggggaggtgggagtggaggaggaggcagtaacataactaatctttgtccattcgatgaagtcttcaatgctacaaagtttgctagtgtatatgcctggaacagaaagcgaatcagtaattgcgtggctgactatagcgtactctataatagcgcatccttctcagcctttaagtgctatggagtaagccccaccaagctgaatgacctctgttttacaaatgtttacgccgatagttttgtcattcgaggtaacgaagtaagccagatcgctcctggccagacaggcaatatcgcagattacaactacaagctgccagacgactttacaggctgcgttatcgcctggaacagtaataagctcgattctaaggtaggaggtaactataactatcgttatcggttgtttaggaagagtaatttgaaaccatttgagagagatatatcaactgaaatataccaagccggtaacaagccttgtaatggtgttgctgggttcaattgttatttcccccttcggtcttatggtttcagacccacatatggtgttggtcaccagccttaccgagtagttgtcctttcttttgaacttctgcacgcacctgccacagtctgcggcccaaagaaaagcactaaccttgtaaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 316 - DNA, 2001 bp, Artificial Sequence
  BA.X-2-dimer-Fc
aacataaccaacctttgcccctttgatgaagtgttcaatgctaccaggttcgcatctgtatacgcctggaacaggaagcgaatatcaaattgcgtggctgattattcagtactttacaattccgctccattttcagcattcaagtgctatggcgtatcccccactaagcttaacgatttgtgtttcaccaatgtctacgctgatagcttcgttatcaggggcaacgaggtgtcccagattgccccagggcaaactggaaatattgccgattacaactacaaactcccagatgatttcactgggtgcgttatagcctggaattcaaataagctggatagtaaggttggtgggaactacaattacctttaccgactctttcggaaatcaaatcttaagccattcgaacgcgacataagtactgaaatatatcaagctggcaataaaccatgcaacggagtagctgggtttaactgttacttcccattgcggtcttatggttttagacctacttatggtgttggccatcagccctatcgggtggtagtccttagtttcgaactcctccatgcccctgccacagtctgcggaccaaaaaagtcaacaaatctcgtaaaaaacaaagggagtggagggggagggtccggaggagggggaagtaatatcacaaacctgtgccctttcgacgaagttttcaacgctacccgattcgcatctgtgtacgcatggaataggaaaagaatttctaattgtgtagctgactacagcgtactctacaattcagcacccttttctgccttcaaatgctacggcgtcagccccacaaagttgaatgacttgtgctttaccaacgtgtatgcagactcctttgtaatacgaggaaacgaggtttctcagatcgctcctggccaaactgggaacattgcagactacaattacaaattgcccgacgattttaccgggtgcgtcatagcttggaattctaacaaattggacagcaaagtgggaggtaattataattatctctatagattgtttcgaaagtcaaacctgaaacctttcgaaagagacatttctacagaaatctaccaagctgggaataagccttgcaacggtgtggccggtttcaattgctactttcctctcaggtcttatggtttcagacccacttacggagttggccatcaaccctatcgcgtggtcgtccttagttttgagttgctgcacgctccagcaaccgtctgcgggccaaagaaatcaacaaacctggtcaaaaataagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 317 - DNA, 2001 bp, Artificial Sequence
  BA.X-3-dimer-Fc
aacatcacaaacttgtgtcccttcgacgaggtgtttaatgcaacacggtttgccagtgtttacgcttggaaccgtaagcgtataagcaactgtgtagcagactattctgtgttgtataattttgcaccattttttgcatttaagtgttatggagtatcccccacaaagctgaacgacctctgcttcacaaacgtttacgccgactccttcgtaatcaggggtaacgaagtctctcagatcgctcctggccaaacaggtaatatagcagactataattacaaacttcccgacgatttcacaggttgtgtgatcgcctggaactccaataagttggattcaaaggtagggggcaattataattatagatatcgtctcttccgcaaatctaacctcaaaccattcgagcgtgacataagcaccgagatctatcaagcaggtaacaagccatgcaatggagtggcaggtttcaattgctattttccattgagatcatatggtttccgtccaacctacggagtcggacaccagccttatcgtgtcgtggtccttagtttcgagttgcttcacgcaccagccaccgtttgcgggcccaaaaaatctactaacttggtaaagaataagggtagtgggggtggtggctccggtgggggtgggagtaatattacaaatctttgcccattcgatgaagtcttcaatgccactcgatttgcttctgtttatgcctggaacagaaaacggataagtaattgtgtagctgactacagtgtcctctataatttcgctccctttttcgctttcaaatgctatggcgtaagtccaaccaaattgaacgacctttgtttcacaaatgtgtacgcagacagtttcgtcattcgaggaaacgaggtttcacaaatagctcccgggcagacaggtaacattgcagattacaactataaacttcccgacgactttactgggtgcgtgatcgcctggaacagcaataagcttgattctaaagtcgggggaaactacaactacagataccggctgttccgcaaaagtaacctgaagcccttcgagagggacatttctaccgaaatatatcaagcaggaaacaagccttgcaatggggtggctggattcaattgctattttccattgcgatcctacgggtttcggcctacttatggtgtgggccatcaaccttatagagtagtggtcctgagcttcgagctccttcatgctccagcaacagtgtgcggcccaaaaaaatctacaaacttggttaagaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 318 - DNA, 2001 bp, Artificial Sequence
  BA.X-4-dimer-Fc
aacatcactaacctctgtcccttcgatgaagtcttcaatgctacaagatttgcttccgtatatgcatggaaccgtaagcgcatttctaattgtgtagccgattattcagtactctataattcagctagtttcagtgcttttaagtgttacggggtatcccctactaaacttaatgacctgtgctttaccaacgtttatgccgattcttttgtcattcggggtaacgaggtatcacagattgctcctgggcaaaccggcaacattgccgattataactataaactgcccgacgattttaccggctgtgtgatcgcatggaatagcaacaaacttgactccaaggtcggtggcaattacaattaccgctatcggcttttcaggaaaagcaatcttaagcccttcgagcgtgacatttcaactgagatataccaggccggtaataaaccctgcaacggtgttaagggctttaattgttactttccactccgttcctatgggttccggccaacatatggggttggccaccagccctaccgggtggtggtcttgtcctttgaattgcttcacgctcccgctaccgtgtgtggtcccaaaaagagcactaatctggtcaaaaacaagggatcaggcggaggaggttccgggggaggggggagcaacatcaccaacctgtgcccctttgatgaggtcttcaacgccacaagattcgcttctgtttacgcatggaatcggaagcgtattagtaattgtgtggctgactacagcgttttgtataacagtgcaagtttcagtgcatttaagtgctacggcgtgagtcccaccaagcttaacgacctttgtttcactaatgtttacgctgacagttttgttataaggggcaatgaagtgtcacagatcgcccctggccaaacagggaatatcgccgactataactataagctccccgatgattttacaggatgtgttattgcttggaatagtaacaagctcgattcaaaggttggcggaaactataactacaggtatcgcctcttcagaaagagcaatcttaagccttttgaaagggatatatcaactgaaatatatcaagcagggaacaagccttgcaatggagtgaagggctttaactgctactttcccctccggagctacggctttagacctacctacggggtcggtcaccaaccttatcgagttgttgttctttcttttgaactgcttcatgcacccgcaacagtctgtgggccaaagaaaagtaccaacctggtgaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 319 - DNA, 2001 bp, Artificial Sequence
  BA.X-5-dimer-Fc
aacattacaaacctttgtccttttgacgaggtcttcaatgccactagatttgcttccgtgtatgcttggaatcggaagaggatcagtaactgtgttgcagactattcagtgctctacaattttgcaccttttttcgcctttaagtgttacggagtgtcccccacaaaactgaacgacctttgtttcactaacgtctatgccgacagctttgtcatccgggggaacgaagtgagtcagatagctcccggccaaactggaaacatagccgattataactacaagctgcccgatgatttcactggctgtgttatcgcatggaacagtaataaacttgactcaaaagttggaggaaactacaattacagataccgcctgttccggaaaagcaaccttaagcccttcgagcgtgacatatcaacagagatataccaagcaggaaacaagccatgtaatggggtcaaggggttcaactgctactttccactccggagttatggattccagcccacttatggagtcgggcatcagccctatcgcgttgtggttcttagtttcgagctgcttcatgctcctgccactgtgtgtggcccaaagaaaagcaccaatctcgtgaaaaataaggggtcaggcggtggtgggtccgggggaggaggaagcaacatcaccaatttgtgccctttcgacgaagtctttaatgctaccaggttcgcttcagtatatgcatggaaccgcaagaggataagcaattgcgtagccgattattccgtactctataatttcgccccctttttcgctttcaagtgctatggagtatcccctactaagttgaacgatctgtgttttactaacgtttacgctgattcatttgttatacgaggcaacgaagtttcacaaatcgcccccggacaaaccggaaatatagccgactataattacaagctgcctgacgatttcactggctgtgttatagcttggaactccaacaagttggatagtaaagtgggtgggaactacaactatcgatatcgactttttagaaagtcaaatctcaagccatttgagagagacatttccacagagatctatcaagctggcaacaaaccctgcaacggggtcaaaggcttcaactgttatttccctttgaggtcctatgggtttcagcctacttacggtgtggggcatcaaccctatagagtagtagttctgagttttgaattgcttcatgcacccgctactgtttgcgggccaaagaaaagtaccaacctggtgaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 320 - DNA, 2001 bp, Artificial Sequence
  BA.X-6-dimer-Fc
aacattactaacctgtgccctttcgacgaagtgttcaatgcaacaagatttgcatctgtctacgcctggaatagaaaacgtatatctaactgtgtagccgattacagtgtattgtacaatagcgcaagtttctccgcattcaaatgttatggggttagtcccactaaattgaacgacctctgctttacaaacgtgtacgcagattcctttgtgatacgcgggaatgaagtttcccagattgcccccgggcagacaggtaacatcgcagattataattataaactgccagatgacttcaccggttgtgttatcgcttggaactctaacaagctcgacagtaaagtaggcggcaactataactatctttaccgactgttcaggaaaagcaaccttaagcccttcgaacgagatataagtactgaaatctatcaggccgggaacaaaccatgtaatggggttgccggattcaactgttatttccccctccagtcctatggattccaaccaacctacggagtcggctaccaaccctaccgcgtcgtggtcttgagtttcgagttgcttcatgctcccgcaactgtttgcggaccaaagaaaagcacaaacctggttaagaacaagggaagtgggggcggaggaagcggcggtgggggttctaacataacaaatctgtgtccttttgatgaagtatttaatgctactagattcgcttctgtgtatgcctggaaccggaaacgtatttccaactgtgtagcagactactcagtactttataatagtgcaagcttttcagcattcaaatgctacggtgtcagccctaccaagttgaacgatttgtgtttcacaaacgtgtacgcagactcatttgtcattaggggaaacgaggttagccagatcgctcccggccagacaggcaacattgccgactacaattacaagttgccagacgactttactggctgtgtgattgcatggaactctaacaaattggactctaaagtgggtggtaactataattatctctaccgcttgtttaggaagagtaatcttaaaccattcgaacgcgatatttccaccgagatctaccaggcaggaaacaagccctgtaatggcgtggctggttttaattgctacttcccacttcagagctatggcttccaaccaacttatggagtgggttatcaaccctatcgagtcgtcgtactgtcttttgaactcctccatgccccagctacagtgtgcggaccaaaaaaaagtaccaatcttgtcaaaaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 321 - DNA, 2001 bp, Artificial Sequence
  BA.X-7-dimer-Fc
aatataacaaacctgtgtcccttcgacgaagtattcaatgctacacggttcgcaagcgtttatgcatggaaccggaagcggatctccaactgcgttgccgattattcagtgctctataacttcgcccccttttttgcattcaaatgctacggggtcagtcccacaaaactgaacgacctgtgttttactaacgtatacgctgacagttttgtaatacgtggaaatgaagtctcacaaatcgcacccggtcagacagggaacatagctgactataattacaaactccctgacgattttactggatgcgtgatagcctggaattccaataaactcgacagtaaagtcgggggtaattataactatttgtatcgacttttccgcaagtcaaacctcaaaccctttgaacgagacatcagtacagagatataccaagctggaaataagccttgtaatggagtggcagggtttaactgctattttcctctcaggagctatggtttccgtccaacttacggggtgggacaccagccttaccgggtcgtcgtgttgtcctttgaattgctccacgcccctgcaaccgtatgcgggcccaaaaagagtaccaacttggttaagaataaggggagtggaggaggtggaagcgggggcgggggctcaaatattactaatttgtgcccattcgacgaggtctttaacgctacaagattcgcttctgtatatgcatggaatcgaaaacgcatttcaaactgtgtagccgattacagcgtcctctataactttgctccatttttcgctttcaagtgttacggcgttagtcccactaaactcaacgatctttgtttcacaaatgtgtacgcagactcatttgtaatccgagggaacgaggtatcccagatcgctcccgggcaaaccggaaacatcgcagattataactacaaacttcccgacgacttcactgggtgtgttatagcttggaattcaaataaacttgactcaaaagtgggagggaattataattacttgtatcggctgtttcgcaaatcaaacctcaaaccctttgaacgagatatttccaccgagatttaccaggcaggtaacaaaccatgcaatggagtcgctgggtttaactgctattttcctctgcggagctacggcttccggccaacatatggcgtcgggcaccaaccctacagggtggttgttctgagctttgaactcttgcacgctcctgccactgtttgcggacccaaaaaaagtactaaccttgtcaagaacaagggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 322 - DNA, 2001 bp, Artificial Sequence
  BA.X-8-dimer-Fc
aatataacaaatctctgccccttcgacgaagtattcaatgccacacggtttgcatcagtctatgcctggaaccgcaagaggattagtaattgcgtcgcagactattctgtgctgtacaatcttgcatccttttcaactttcaaatgttatggcgtctctccaacaaaactgaacgacctgtgttttacaaacgtttacgccgattccttcgtgataaggggtgatgaagtacggcaaattgcaccaggtcaaactggcaacatcgcagactacaactataagcttcctgacgacttcacaggttgtgtcatcgcatggaattctaacaaattggatagcaaagtgtcagggaattacaactacctttatcgtctctttagaaagtctaacctcaaaccattcgaaagagatatatctactgagatttatcaggcaggcaataagccatgtaatggggtggcaggatttaactgctattttccacttcgttcttactctttccggccaacttacggtgtcggacaccaaccctacagagtggtcgtgctgtctttcgaactcctgcatgcacccgccactgtctgtggacctaaaaagagcactaacctggtgaaaaataagggtagcgggggtggcggcagcggaggtgggggttcaaacataactaacctttgtccctttgacgaggtattcaacgcaactagatttgcatctgtctacgcttggaataggaagcggatctccaactgcgttgctgattacagtgtgctctacaacttggcatcttttagcacctttaagtgttacggggtaagccctacaaaactcaacgatctttgtttcactaacgtgtacgcagacagttttgtgattcgaggggatgaggttcgtcagatcgctccagggcaaacaggaaacatagctgactacaattacaagcttcctgacgacttcaccggatgcgtcattgcctggaactcaaataaactggactcaaaagtgagtgggaattataattacctgtataggctcttccggaagtcaaacctgaaacctttcgaaagggacatatcaacagagatttatcaagccggtaataaaccctgcaacggggtcgctggcttcaactgctactttccattgcgtagttatagctttcgaccaacttacggggtaggccatcaaccctacagagttgttgtcctgagtttcgaactgctgcatgctccagctactgtgtgtgggcctaagaaaagtaccaaccttgtcaaaaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 323 - DNA, 2001 bp, Artificial Sequence
  BA.X-9-dimer-Fc
aacatcacaaacctctgtccctttgacgaggtgttcaacgctactaaattcgcctccgtctacgcttggaatcgcaagagaatctctaattgtgttgcagactacagtgtgctctataatagtgctagtttttccgccttcaaatgctacggtgtgtcaccaaccaagctcaatgatctttgttttacaaacgtttatgccgattccttcgttataaggggaaatgaggtctcacaaatcgctcccggtcaaactggaaatatagctgactacaactacaaactgccagacgacttcactggttgcgttatcgcatggaatagtaacaaattggattcaaaagttagcggcaattacaactataggtatcggcttttcaggaaatctaatctgaagcctttcgagagagacatatccactgaaatatatcaagctggtaataaaccctgtaatggggtaaaggggttcaattgttactttcctctgcgatcttatagcttccgacccacctacggagtcgggcaccagccataccgagtggtcgttctctccttcgagctcctgcacgcaccagcaacagtttgcgggcccaaaaaatcaactaatttggtgaaaaacaagggctcagggggtgggggttctggcggtggtggatcaaacatcactaacctgtgtccctttgatgaggtatttaacgctactaagtttgcatccgtttatgcctggaaccgaaagcggatctccaactgcgttgcagattactcagtactctacaacagcgcttccttctcagcatttaagtgctatggagtgagtcctactaagctgaacgatctgtgcttcacaaacgtttacgcagactcctttgtcattaggggtaacgaggtatctcagatagctccaggtcagactggaaacatcgcagactataactacaagcttcctgacgacttcactggctgcgtaattgcttggaatagtaacaaactggattctaaggtcagcggaaattacaactaccgctatagactgttccgtaaatcaaatctgaaaccatttgaaagagacatttctactgaaatctatcaggcaggtaacaagccctgcaacggagttaaggggttcaattgttacttccccttgcgaagctattctttcaggcccacctatggtgtaggacaccaaccttatagagtggttgtccttagctttgaactccttcacgccccagccaccgtttgtggccctaaaaagagtactaatctcgtaaaaaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

SEQ ID NO: 324 - DNA, 2001 bp, Artificial Sequence
  BA.X-10-dimer-Fc
aacattacaaatctttgtcctttcgatgaggtctttaatgcaacacgcttcgcctccgtttacgcttggaatcggaagcgcatttcaaactgcgtcgctgactactccgtgctctacaactctgctccattcagcgcttttaagtgttatggcgtgtcacccacaaaacttaacgacttgtgtttcacaaacgtatacgccgacagtttcgtcatccgaggtaatgaagttagccagatagctcctggtcagaccggaaacatcgcagactacaattataaattgccagacgatttcacaggctgcgtgattgcttggaactctaataaactggactctaaagtgggcggaaactacaattatcgttaccgcctttttcggaaatccaatttgaaaccttttgaacgtgacatcagtactgaaatctatcaggcaggtaataagccatgcaatggggttgctggattcaattgttattttcccctccgttcatacggatttaggcccacctatggtgttggccatcaaccctaccgagtggtagtactctcatttgaactccttcacgctccagcaactgtatgtgggcccaaaaaaagtactaaccttgtcaagaataagggatcagggggtgggggtagcggcggcggcggctcaaacataactaacctttgccccttcgatgaggtgtttaatgctacccggtttgccagtgtctacgcatggaaccgcaaaaggatatccaattgtgtcgccgattacagtgtactgtataactccgctccttttagtgccttcaaatgttacggggtatccccaactaaactgaatgatctctgtttcactaatgtttatgctgattccttcgtgattcgggggaacgaagtgtcacagattgcccctggtcaaaccggtaatattgccgattataactacaaactcccagatgatttcaccgggtgtgttattgcctggaattcaaataagttggactccaaggtgggagggaattacaattatcggtatcgactttttcggaagtccaacctgaagcctttcgaacgcgatatttcaaccgagatctatcaggccgggaataagccttgtaacggggtggcaggatttaattgttatttccccctccgcagctatggcttccgtcctacatatggcgtgggacatcaaccctatcgagtggtggtactttcctttgaactgcttcacgcccctgccactgtttgcgggcctaagaagtctaccaatttggtaaagaacaaaggatccggcggcggcggtgacggtggtggcggctccggagacaagacccacacctgccccccttgtcctgcccctgagctgctgggcggaccctccgtgtttctgttcccccccaagcccaaggacaccctgatgatcagccggacccccgaggtcacctgcgtggtggtggacgtcagccacgaggacccagaggtcaagttcaattggtatgtggacggcgtggaggtgcacaacgccaagaccaagccccgggaggaacagtacaacagcacctaccgggtggtgtccgtgctgaccgtgctgcaccaggactggctgaacggcaaagaatacaagtgcaaggtgtccaacaaggccctgcctgcccccatcgagaaaaccatcagcaaggccaagggccagcccagagaaccccaggtgtacaccctgccccctagcagggaagagctgaccaagaaccaggtgtccctgacctgtctggtcaagggcttctaccccagcgatatcgccgtggagtgggagagcaacggccagcctgagaacaactacaagaccaccccccctgtgctggacagcgacggcagcttcttcctgtacagcaagctgaccgtggacaagagccggtggcagcagggcaacgtgtttagctgcagcgtgatgcacgaggccctgcacaaccactacacccagaagagcttaagcctgtcccctggcagttga

The invention claimed is:

1. A recombinant polypeptide comprising at least one immunogenic fragment of Severe Acute Respiratory Syndrome Coronavirus 2 (SARS-CoV-2) spike glycoprotein comprising an amino acid sequence with at least 93% sequence identity to an amino acid sequence selected from the group consisting of SEQ ID NOs: 245-254.

2. The recombinant polypeptide of claim 1, wherein the polypeptide comprises at least two SARS-CoV-2 spike glycoprotein immunogenic fragments.

3. The recombinant polypeptide of claim 2, wherein two immunogenic fragments of the at least two immunogenic fragments comprise the same amino acid sequence.

4. The recombinant polypeptide of claim 2, wherein two immunogenic fragments of the at least two immunogenic fragments comprise a different amino acid sequence.

5. The recombinant polypeptide of claim 1, wherein the polypeptide comprises at least one immunogenic fragment comprising an amino acid sequence with at least 93% sequence identity to the amino acid sequence of SEQ ID NO: 245.

6. The recombinant polypeptide of claim 1, wherein the polypeptide comprises at least one immunogenic fragment comprising an amino acid sequence with at least 93% sequence identity to the amino acid sequence of SEQ ID NO: 248.

7. The recombinant polypeptide of claim 1, wherein the polypeptide comprises at least one immunogenic fragment comprising an amino acid sequence with at least 93% sequence identity to the amino acid sequence of SEQ ID NO: 252.

8. The recombinant polypeptide of claim 1, wherein the polypeptide comprises at least one immunogenic fragment comprising an amino acid sequence with at least 93% sequence identity to the amino acid sequence of SEQ ID NO: 254.

9. The recombinant polypeptide of claim 1, wherein the polypeptide comprises at least one immunogenic fragment comprising an amino acid sequence with at least 93% sequence identity to the amino acid sequence of an amino acid sequence selected from the group consisting of SEQ ID NOs: 245-254, wherein the at least one immunogenic fragment further comprises one or more of the following amino acid substitutions: G339D, R346K, S371F, S373P, S375F, T376A, D405N, R408S, K417N, N440K, G446S, L452R, S477N, T478K, E484A, E484K, Q493R, G496S, Q498R, N501Y, and Y505H.

10. The recombinant polypeptide of claim 2, wherein the at least two immunogenic fragments each comprise an amino acid sequence with at least 93% sequence identity to the amino acid sequence selected from the group consisting of SEQ ID NOs: 245-254.

11. The recombinant polypeptide of claim 1, wherein the polypeptide comprises an amino acid sequence with at least 93% sequence identity to the amino acid sequence selected from the group consisting of SEQ ID NOs: 255-264.

12. The recombinant polypeptide of claim 1, wherein the polypeptide comprises an amino acid sequence with at least 93% sequence identity to the amino acid sequence selected from the group consisting of SEQ ID NOs: 275-284.

13. The recombinant polypeptide of claim 2, wherein the at least two immunogenic fragments are connected to each other via a linker, and wherein the linker is a polypeptide comprising an amino acid sequence of 1-35 residues, wherein each residue is independently serine or glycine.

14. The recombinant polypeptide of claim 1, wherein the at least one immunogenic fragment of the SARS-CoV-2 spike glycoprotein is connected to an antibody Fc region via a linker, wherein the linker comprises an amino acid sequence selected from the group consisting of SEQ ID NO: 65, SEQ ID NO: 67, SEQ ID NO: 69, SEQ ID NO: 193, SEQ ID NO: 195, and SEQ ID NO: 197.

15. A pharmaceutical composition comprising the recombinant polypeptide of claim 1 and a pharmaceutically acceptable carrier.

16. The pharmaceutical composition of claim 15, wherein the pharmaceutical composition comprises an adjuvant.

17. The pharmaceutical composition of claim 15, wherein the pharmaceutical composition does not comprise an adjuvant.

18. A pharmaceutical composition comprising the recombinant polypeptide of claim 2 and a pharmaceutically acceptable carrier.

19. A pharmaceutical composition comprising a recombinant polypeptide, the recombinant polypeptide comprising at least two immunogenic fragments of Severe Acute Respiratory Syndrome Coronavirus 2 (SARS-CoV-2) spike glycoprotein, and wherein at least one of the at least two immunogenic fragments comprises an amino acid sequence with at least 97% sequence identity to an amino acid sequence selected from the group consisting of SEQ ID NOs: 245-254.

20. The pharmaceutical composition of claim 19, wherein at least two of the at least two immunogenic fragments comprises an amino acid sequence with at least 97% sequence identity to an amino acid sequence selected from the group consisting of SEQ ID NOs: 245-254.

* * * * *